United States Patent 12,569,549 (FLAVIVIRUS VACCINE) - sequence listing, part 42

SEQ ID NO: 15655 - RNA, 9873 nt, synthetic construct
  misc_feature 1..9873: note = derived and/or modified CDS sequence (opt3) from DENV-3__KC261634__SS-prME
  source 1..9873: mol_type = other RNA
accagcatctgcctgatgatgatgctccccgccacacttgctttccacctgacttccagagacggcgagcctaggatgattgtggggaagaacgaacggggaaaatctttgttatttaagacggcatcaggtataaatatgtgtaccctgatcgccatggatctaggcgagatgtgcgacgatacagtcacttacaaatgtccactcattgcggaagttgagccggaagacatcgattgctggtgtaacctgaccagtacatgggtgacctatgggacttgcaatcaggctggagagcatcgccgagacaagcgtagcgtagcccttgcaccccacgtgggcatgggtctggatacaagaacccaaacgtggatgtccgccgagggggcttggaggcaggtcgaaaaagtggagacttgggcattgcggcatcctggattcaccattctcgccctgtttctggctcactacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcatggcgggtgcgtgacgactatggcgaagaataggcccacactagacattgagctccagaaaaccgaagcaactcaactggccacacttcggaagctgtgtatcgagggaaaaattaccaacatcacgaccgatagccgctgccctacacagggcgaagctgtcttgccagaggaacaggaccagaattatgtttgtaagcacacttacgtggatcgaggttgggggaacggatgcggcctcttcggcaaagggagtctggtaacctgcgccaagtttcaatgtttagagcccatagagggaaaggtggtccagtatgaaaatctgaaatacacagtgattatcactgttcacaccggtgaccagcatcaggtgggcaacgacacacaaggggtcaccgtggagattactcctcaggcatccacggtagaagctgttctcccagagtatggaacacttggcctggaatgctctccgagaaccggtttggatttcaatgagatgatcctactgactatgaagaacaaagcctggatggtgcacaggcagtggtttttcgacctccccctgccttggaccagcggggcgacaaccgagactccaacatggaatcggaaggaacttctggtcacgtttaaaaacgcccatgcaaagaaacaagaggtggtcgtgttgggctcccaggaaggagctatgcacaccgccctcactggcgctacagagatccagaattcagggggaaccagtattttcgccggtcacctgaagtgtcgtttaaagatggataaactggaactaaagggcatgagctacgcaatgtgcctcaacacatttgttctgaaaaaggaggtgtctgagactcagcatgggaccatacttatccgcgtagaatacaaaggagaggacgccccctgtaagattcctttctccacggaagatggccaaggtaaggctcacaacgggagattgatcaccgcgaatccagtcgtgacaaaaaaggaggagcccgttaacatagaagcagagccgcctttcggcgaatcaaatattgtgatcggaactggcgacaaagccctgaagatcaactggtataaaaaggggagcagtattggaaagatgtttgaggctaccgccaggggtgcacggcgaatggccatcctcggcgatacagcttgggacttcgggtctgtcggaggcgtgctgaattcccttggtaaaatggcccatcagatttttgggagcgcatacactgcgctgttctcgggcgtatcttggataatgaagatcggaattggcgtgttgctcacctggatcgggctgaactccaaaaatacgtcaatgagttttagctgcatcgttattggaataatcacattatatctgggcgctgtcgtgcaggccgatatgggttgtgtgattaactggaaggggaaagaactaaagtgcggatccggcatcttcgtcaccaatgaggttcacacttggacagagcagtacaagtttcaagcagactctcccaaacgcctcgccaccgctattgccggtgcatgggaaaacggcgtgtgtgggatcagaagcactaccaggatggagaatctgctttggaagcagatagctaacgaattgaattatatcctgtgggagaacaatattaaactcacagtggtagtcggagatatcattggcgtgctggaacaggggaagcggacgttaaccccacagcctatggagctgaaatactcatggaagacttggggaaaagccaagatcgttacagcggagatacaaaacagttccttcattatcgacggccccaacaccccagaatgccccagcgcctctcgcgcttggaatgtgtgggaggtcgaagactatggttttggggtgttcacaactaacatttggcttaagttgagagaggtttacacccagtcatgtgatcataggctcatgagtgcagccatcaaagacgaacgtgctgtgcacgccgatatgggatactggatagagagccagaagaatggctcctggaaactggagaaggcatcttttatcgaagtaaaaacgtgcacatggcctaagtcgcacaccctatggagcaacggtgtcctggagtccgacatgattatcccaaagtcactcgcgggcccgattagtcagcataatcaccggcccgggtatcatactcaaaccgccggaccttggcacctgggcaaacttgaattggatttcaactactgcgaggggacaactgtggtgatcaccgagaattgtggaacacgaggcccatctctgagaacgaccactgtcagcggtaagttaatacacgaatggtgctgtaggtcctgcacactcccccctctgcgctatatgggggaggacggatgttggtacggcatggaaattcggccaatcaacgagaaagaagagaatatggttaagtcacttgtgagcgctggttctggcaaagtagataactttaccatgggggtgctgtgcttggccatcctcttcgaggaagtcatgagaggaaagttcggcaagaaacatatgattgtgggggttctgtttactttcgtgctactgctctccggacagatcacatggagggacatgacccacacgctgattatgataggcagtaatgcaagcgatcgcatgggtatgggggtcacttatcttgctttgatcgccacctttaagattcagcccttcctggcattaggatttttcctccgaaaactgacatctcgggagaaccttctgctaggcgtgggcctcgccatggctaccactctgcaattgccggaagacatcgagcagatggcgaatgggattgccctgggattaatgacactcaagctgatcacccagtttgaaacataccagctttggactgcactggtttccttgacctgttcaaacacgatattcacactcaccgtggcttggcgtactgccaccctgatcctagccggtgtcagtctgcttcctctctgccaaagctcgtccatgagaaaaacagattggctgccaatgactgtagctgcaatgggcgtgccccctttgcccctgtttattttctctttaaaggacgccccaaagaaaaggagctggcctctcaatgagggggttatggcggtgggactggtctcaatccttgctagttccctgttgcgcaacgatgtgcccatggccggcccactcgtagcaggtgggctgctaattgcctgttatgtgatcaccggaacgtctgctgacctgacagtcgagaaggcagccgacgttacctgggaagaggaagcggagcagactggcgtgagccataaccttatgataacagtggatgacgatggcaccatgcggattaaagacgatgaaactgagaatatcctcacagtcctgttgaagaccgctttactgatcgtgtccgggatttttccgtactcaatacctgccacgctcctggtttggcacacttggcagaaacagacccaaagaagcggagtactttgggacgtgcccagtccacccgagacacagaaggcagaactggaggaaggtgtctacaggatcaaacagcagggcattttcgggaagacccaagtgggagttggcgtgcagaaggagggtgtctttcatacaatgtggcacgtgactcgaggggccgtattgacccacaacggaaaacgcctagagcctaattgggcttctgtcaagaaagatctgatctcctatggcggcgggtggcggctcagcgcccagtggcaaaagggagaagaggtgcaggttattgcagtggaaccaggtaaaaaccccaagaatttccagacgatgcctggcatcttccagacaactaccggggagataggagctatcgccctggactttaagccgggcacatcgggttcaccaattatcaacagagaagggaaagtcgtgggactttacggcaatggcgttgtgaccaagaacgggggatatgtctctggtattgcgcaaactaatgccgagcccgatggccctaccccagagttagaagaggaaatgttcaaaaagaggaacctgacaatcatggacctccatcccgggagtggaaaaacgcgtaagtacttgcctgcaatagtgcgcgaggctattaagcggagactgaggactctcatcctggccccgacccgagtagtggctgcagaaatggaggaggcccttaaaggcctgcccatccggtatcagacaaccgccactaagtccgaacacacaggtcgcgagattgttgatttgatgtgccatgctacctttacgatgagactactgagcccagtcagggtgcctaattacaacctcatcataatggacgaagcgcacttcactgatcccgcatctattgccgctcgggggtatatcagcacacgagtgggaatgggcgaggccgcagccatttttatgaccgctaccccacctggcactgcggaagccttcccccagtccaatgcaccaatccaggacgaggagagagacataccggaacgctcatggaacagtgggaatgagtggattacagattttgtcggaaaaaccgtatggttcgtgcctagcatcaaggctggtaacgacatcgccaactgtttaaggaaaaatggcaagaaggttattcaactgtctcgtaaaacatttgatactgaataccagaagacgcggcttaacgactgggatttcgtggtcaccacagacatctccgagatgggggcaaattttaaagccgatagagtgattgaccccaggcgctgcctgaagccagttatactcactgatggacccgagcgagtgatcttggctggccctatgccagtcaccgccgcgtcagcagcccagagacggggtagggtggggcgcaacccccagaaagaaaatgaccaatacattttcacaggccagcctctgaacaatgatgaggaccatgctcactggaccgaagccaagatgctcctggacaacatcaatactccggagggaatcattccagctcttttcgaacccgagcgtgagaagagtgcagccatagatggcgaatatagactaaaaggggagagccggaagacgtttgtagaactgatgaggcgcggagacttgcctgtgtggttagctcacaaagttgcctccgagggtatcaagtacaccgatcgaaaatggtgcttcgacggcgaaagaaacaatcagattctggaggagaacatggatgtcgaaatctggacaaaggagggggaacggaaaaagctcaggccccgctggctggacgcaagaacttattctgatccacttgcgctgaaggagtttaaagacttcgccgctggaaggaagtcgattgccctcgatttggtgaccgaaatcggccgggtgcctagccatctggcacaccgtacacgcaatgctctagacaacctggtcatgctccatacctcagagcacggtgggcgagcctacagacacgcagttgaggaacttcccgagactatggaaacactgttattgctgggcctcatgatactgcttacgggaggcgccatgctgtttctcatctccgggaaaggaattggtaagaccagtatcggcttgatttgtgtgatcgtatctagcgggatgctgtggatggctgatgtgccattacagtggatagcgtccgccattgtcctagagttctttatgatggtgctgctcatccctgagccggaaaaacaaaggactccccaggacaatcagcttgcatatgttgtgattggaatcctgacattggctgccatagtcgccgcaaacgagatgggcctgctcgaaaccaccaagcgggatctgggtatgtcaaaggagccaggggctgtatctagcacaagttaccttgacgtggacctccatcctgcctccgcgtggactctgtatgctgttgccacgaccgtgatcacacccatgttgcgccacactattgaaaatagcaccgcaaacgtctctctggccgctatcgcaaaccaagccgtggtcttaatgggcctagataaaggatggccaatttcaaagatggacctgggcgtgcctctccttgcgctggggtgctactcccaggttaatcccttgacactgaccgctgccgtgctcctgcttgtaactcattacgcaatcataggaccgggcttacaggccaaagctacgagagaggcccagaagaggacagcagctggtattatgaaaaacccaaccgtggatgggatcatgactatcgacctggatcctgtcatttatgacagtaagttcgagaagcaactcggacaggttatgttgctggtgctatgtgccgtccagctgctccttatgcggaccagctgggcgctgtgcgaagccttgacactggcaactggccccatcaccacactctgggagggttcgccaggcaaattttggaatacgaccatagctgtgtctatggccaacattttccgagggtcctacctggcaggagctggcttagcctttagcatcatgaagtcagtagggactggaagacgcggcacaggtagtcagggggaaacccttggagagaaatggaagaaaaggctgaatcaactctctcggaaggaattcgatctatataagaaatccggcattactgaggtggaccgtacagaggccaaggaaggtctgaaaagaggcgagaccacgcaccatgcggttagcagggggtcagctaagttgcagtggtttgtggaacgcaacatggtcatccccgagggacgggtgatagatctgggctgtgggcgaggaggctggagttactattgcgcaggtctcaaaaaggtcaccgaagtgagagggtacacaaaaggaggccctggccacgaggagccggttcccatgagcacttatgggtggaatatcgtaaagcttatgtccggaaaggacgtgttctacctgccacctgaaaaatgtgataccttgctgtgcgacattggtgagtctagcccctcccctacagtcgaagagtcaaggactatccgcgtgctcaagatggttgagccatggttaaaaaacaatcagttctgtattaaggtgctgaacccctacatgcctaccgtcatcgaacaccttgagcggctgcagagaaaatatggcgggatgctagtgcgtaatccactctctaggaacagtacacatgaaatgtactggatttcgaatggaaccggcaacatcgtaagctccgtgaatatggtttctcggctgttgctgaaccgctttactatgacgcaccgaagacccacaatggagaaggatgtcgacctcggtgccgggaccaggcatgtgaacgctgaaccggagactcctaatatggacgtgataggagagcggattaagcgcatcaaagaagagcactcaagcacctggcactatgatgacgaaaacccatacaagacatgggcctatcatggctcctacgaggtcaaagcaacgggcagtgcctctagcatgatcaatggggttgtgaagcttctgaccaaaccctgggatgtagtgcctatggtcactcaaatggctatgacagacaccactccattcggacagcagagagtgtttaaggaaaaggttgatacaaggaccccccgaccgatgcctggtacacggaaagtgatggagattactgcggagtggttatggcgtaccctgggcagaaacaagaaaccccgcttgtgcacgagggaagagttcaccaagaaagtccggacaaatgccgcaatgggggctgtgtttactgaagagaaccaatgggactcagccagagcagccgtagaagatgaggagttctggaagctcgttgaccgcgaaagggagctgcaccgactaggaaagtgtggctcctgcgtgtataatatgatgggtaaacgggaaaagaaacttggggagtttggaaaggctaaaggcagtagagccatatggtacatgtggctgggcgcgaggtacctcgagttcgaagcactggggtttttgaacgaggatcattggttcagccgcgaaaattcttattccggagtcgagggtgaaggcctgcacaagctcgggtacatccttcgtgacatttcaaaaatcccaggaggcgccatgtatgctgatgacaccgccggttgggacacacggattactgaggatgacctgcataacgaggaaaagatcacccagcagatggatcctgagcacagaaggttagcaagcgctatatttaagctgacgtaccagaataaagtggtgaaggtccaacgccccacaccaaaagggaccgttatggacatcatttcgcgaaaggatcagcggggatctggccaggtgggcacttatgggttgaacacattcaccaatatggaagcccagctcgtaagacaaatggagggagaaggtgtgctgagtaaagctgacctagaggatccccaccttctggagaagaagatcactcagtggctcgaaaccaaaggcgtcgagaggctgaagcgcatggccatttccggggacgattgcgtggttaaacctatcgacgatagatttgcaaacgcgttgttagccctgaatgacatgggaaaggtgcggaaagatataccacagtggcagccgagcaagggctggcatgactggcaacaggtccccttctgttcacaccatttccacgaactcattatgaaggacggtaggaaacttgtggtaccttgccgtccacaggatgagctgatcgggcgagctcgcatctcccagggagccggctggtctctaaaggaaacagcatgtctgggcaaagcttacgcccaaatgtggagcctcatgtattttcacagacgggacttgaggctggcaagtaacgccatttgctccgcggttcccgtgcattgggtccctacgagccgcaccacttggtctatacacgctcatcaccagtggatgacaaccgaggatatgcttactgtgtggaacagagtttggatcgaggacaatccatggatggaagataagacacccgtgaccacgtgggaggacgtcccttacctggggaaacgggaagatcagtggtgtggatcactcattggtttaacaagtagggccacctgggcacaaaacatcctgactgccattcagcaggtgcgatccttgatcggcgacgaggagttcctggattacatgccgagcatgaagcgttttagaaaggaagaggaatctgagggggctatatggtga

SEQ ID NO: 15656 - RNA, 9873 nt, synthetic construct
  misc_feature 1..9873: note = derived and/or modified CDS sequence (opt3) from DENV-3__JN662391__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcagaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggagtacaagggagaagatgctccctgtaaaatccctttctccacagaggacgagcaaggcaaggcgcataacggtcgtcttataactgcaaatccagttgtgaccaaaaaggaagagcccgtaaacattgaagccgagccgcctttcggggaatcaaatatcgtcatcggcattggagataacgctttgaaaatcaattggtataagaagggcagcagtattgggaaaatgtttgaggccacagcacgcggagccagaaggatggctatactgggtgacactgcctgggatttcggctctgtggggggagttctcaactccctgggcaagatggtgcaccagatctttggtagcgcatacaccgcgcttttctcgggggtctcttgggtgatgaaaattggcatcggagtactgttgacgtggatcggcctcaattccaagaacacatcaatgagttttagctgcattgctatagggatcattaccctgtatttaggagccgtggttcaggcagacatgggctgtgtcatcaattggaaaggtaaggagctgaagtgcgggtccggaattttcgtgactaacgaagtgcatacatggaccgagcagtacaaatttcaagccgattctcccaagcggctagctactgccatcgcaggcgcttgggaaaatggtgtctgtggcatacgaagcaccacacgcatggagaacctcctgtggaaacagatcgccaatgaacttaactatattttgtgggagaataacatcaagctgacggttgtggtgggggacaccattggagtactcgagcagggcaaaagaactctgacaccacagcctatggaattaaagtactcatggaaaacctgggggaaggcgaagatcgtcacagccgagactcaaaacagttccttcataattgatggacccaataccccagaatgccccagcgcttctagggcatggaacgtgtgggaggttgaagactatggctttggtgtgttcacgacaaatatctggctgaaacttcgggaggtctacacccagatgtgtgaccaccgcttgatgtcagccgctgtgaaggatgagagagccgttcacgcagacatggggtactggattgaaagtcagaaaaacggaagctggaagctcgagaaagcgtccctgatcgaagtgaagacttgcacctggcctaagtctcatacactatggtcgaatggcgtactggagagcgatatgataatcccaaaatccctcgccggtccgatttcacagcacaactataggcccggctaccatactcaaaccgctgggccttggcacctgggaaagcttgagttggactttaattattgcgaaggcacaacggtcgtgatcaccgagaactgtgggactcgtggaccaagtctgcggacaaccactgtgtctggcaaattaattcacgaatggtgctgtcgaagctgcacactcccccctctgagatacatgggtgaggatgggtgttggtatggaatggaaatcaggccaatatccgagaaggaggaaaatatggtcaaatcacttgttagcgccggctctggtaaggtggacaacttcaccatgggcgtactgtgcttggcaattctctttgaggaagtgatgcgcgggaagttcggaaaaaagcatatgatcgctggcgtcttcctgacgtttatgctactgctctccgggcagatcacttggcgggatatggcccacaccctgattatgatcggaagtaatgcaagcgacagaatgggcatgggtgtgacataccttgccttgattgctaccttcaaaatacagccctttctggcgttagggttctttctcaggaagctgacttctcgcgagaaccttctgctaggagttggcctcgccatggcaacaaccatccaactgccggaagatattgagcagatggctaatggcatcgccttggggctgatggccttaaaactcattacacagttcgagacttatcagctgtggaccgctcttatctccctgacgtgttcaaacacaatatttaccttgactgtggcatggcgaaccgccacactcatcctggcgggagtcagtctactgcctgtgtgccaaagctcgtccatgcggaagactgactggcttccaatgaccgttgctgccatgggtgtgccccctctccccctgttcattttttctttgaaggatacgctgaaacgtagaagctggccattaaatgaaggcgtcatggcagtagggctcgtgtcaatcctggccagttcccttctgaggaacgacgttcctatggctggacccttggtggcaggcggtctcctgattgcctgttacgtcatcacagggacctctgcggatctaactgtggagaaggctgccgacgtaacatgggaagaggaagcagagcagaccggagtgagccataacctgatgataactgtcgacgatgacggcacaatgcgcattaaagatgacgagaccgaaaatatccttacggttctcctgaagactgccttgttaatcgtgtccggcattttcccatactcaataccggctaccctgctcgtgtggcacacatggcagaaacagacccaacggagcggggtcctgtgggatgtgcctagtcccccagagacacagaaggccgaacttgaggagggagtttatagaatcaaacagcagggtattctgggcaagactcaagtaggggtgggagtccagaaggaaggcgtgtttcataccatgtggcacgttacgaggggtgcagtgttgacacacaacgggaaacgactagagcccaattgggcttctgtcaagaaagacctgatctcctacggaggcggctggcgcctcagcgcccagtggcaaaagggggaagaggtgcaggtaattgcggtcgaacctggaaaaaacccaaagaatttccagactatgcccggtacctttcagacaaccactggcgagatcggggccatagcactggatttcaagcctggaacctcgggctcaccgatcattaaccgggagggtaaagtggttgggctttatggaaatggcgtggtcacaaagaacggcgggtacgtgtctggaatcgctcaaacgaatgccgaaccagacggtcccactcctgagttagaagaggaaatgttcaaaaagagaaacctgaccattatggatctccatccaggcagtgggaaaacaaggaagtatttgcccgctatcgttcgtgaggcaataaagcgccggctgagaaccctcattctggcccctactagggtggtcgccgctgagatggaagaggcgcttaaaggactgccgatccgataccagacaaccgcaacgaagtccgaacacactggccgggagatcgtggacttgatgtgccatgccacatttaccatgcgcctactgagccccgtaagagtgccaaattataacctcattatcatggatgaagctcacttcaccgaccctgcctctatagcagccaggggttacattagcactcgggttgggatgggagaggctgcggccatctttatgacagcaacccccccaggcacagctgatgccttccctcagtccaatgcacccattcaggacgaggaacgagacatcccagagagatcatggaacagtggcaatgaatggataactgattttgccgggaaaacggtctggttcgtgccgagcattaaggctggaaacgacatcgccaactgtttacgcaaaaatggtaagaaggtgatccaactgtctaggaaaacctttgatacagagtaccagaagactaaacttaacgactgggatttcgtcgtaaccacagacatttccgagatgggcgcgaattttaaggcagatcgtgtgatcgaccctcggagatgcctgaaacccgttattctcaccgatgggccagaaagggtgatattggccggacccatgcctgtcactgtggcttcagccgctcagcgccgaggcagagttggtcggaacccacagaaggagaatgaccaatatatcttcacggggcagcccctgaacaatgatgaagaccatgcacactggaccgaggccaagatgctcctggacaacattaatacacctgaaggcatcatcccggctctttttgagccagagagggaaaaaagtgccgcaattgatggagagtaccgcctaaagggcgaaagccgtaaaactttcgtggagctgatgagacggggggacttgcccgtctggttagcgcacaaggtggcctccgaaggaataaaatataccgataggaagtggtgcttcgacggtcagcgcaacaatcagatcctggaggagaacatggatgtagaaatttggacaaaagagggcgaaaagaagaaactccgacctagatggctggacgctcggacctactctgatccccttgccctgaaggagtttaaagacttcgcagctgggaggaagtcgatcgccctcgatttggtgactgaaattggacgcgttccaagccatctggcacacagaacaaggaatgccctagacaacctggtcatgctccatacgtcagagcacggcggtcgggcttatcgtcacgcggtggaggaacttcctgagaccatggaaactctgttattgctggggctcatgatcctgcttacaggcggagccatgctgtttctcatatccggcaaagggatcggaaagaccagtattggtttgatctgtgtgattgcatctagcggcatgctgtggatggctgagatccccttacaatggatagcctccgccattgtcctagagttctttatgatggttctgctcatcccagaacctgagaagcagcgcaccccgcaggataatcaacttgcatacgtggtaattgggatcctgacattggctgccataatcgcggctaacgaaatgggactgctcgagactacgaaacgagacctgggcatgtcaaaggaacccggtgtggtctctccaaccagctatcttgatgtggacctccatcctgccagtgcatggacactgtacgccgttgctactaccgtgattacacccatgttgagacacaccatcgagaattccactgcaaacgtcagcctggccgcgattgctaaccaggccgtagtgttaatggggctagacaaaggctggccaatctctaagatggatctgggagttcctctccttgcactgggctgctactcacaggtgaatcccttgacgctgacagccgctgtcctcctgcttgtgacccattatgccataattgggccgggattacaggcaaaagctactagggaggcccaaaagcggaccgcggccggcatcatgaagaacccaacagtcgacggtatcattactatcgatctggaccctgtgatatacgattccaaattcgaaaagcagctcgggcaggttatgttgctggtgctatgtgcagtacagctgctccttatgcgcaccagttgggctctgtgcgaggccttgacactggcaacgggacccattaccactctctgggaaggcagcccaggtaaattttggaatacaaccatcgctgtgtcgatggccaacattttcagaggctcttatctggccggggcgggattagctttttccatcatgaagagcgtcggcactgggaaaaggggaacaggctcacaaggtgagacccttggggaaaagtggaagaaaaagctgaatcagctcagtcggaaagagttcgacctatacaagaaatctggaataacggaggttgatcgaaccgaagcaaaggagggcctgaaaagaggtgaaacaactcaccatgccgtgtcccgcggcagcgctaagttgcagtggtttgtcgagaggaacatggtgatccccgaagggcgggtaattgacctgggatgtggccgtgggggatggtcatattactgcgccggcctcaagaaagtgaccgaggttagaggttatacaaaggggggacctggccacgaggaaccggtgcccatgagtactcacggctggaatatcgtcaaacttatgagcgggaaggatgtgttctacctgccacctgagaaatgtgacaccttgctgtgcgatattggagaatcctctcccagccctacagtcgaggagtccaggaccatccgcgtgctcaagatggttgaaccatggttaaagaacaatcagttttgtattaaagtactgaacccctacatgcctgcagtgatcgagcatcttgaacggctgcaacgaaagcacggtggcatgctagtcagaaatccactctcaaggaactctactcatgagatgtattggataagtaatgggacgggaaacattgtgtcgagcgttaatatggtgtcccgcctgttgctgaaccggttcacaatgacccacagacgtcccactatcgaaaaagacgtcgatctcggcgccggtaccaggcacgtgaacgctgagccggagacacctaatatggacgtaatcggggaacggattcgccgaataaaggaggaacataactctacgtggcactacgacgatgagaatccatataaaacctgggcgtaccatggatcatatgaagtgaaggccactggcagcgcatccagtatgatcaacggcgttgtcaagcttctgacaaaaccctgggacgtggtgcctatggtcacccagatggctatgactgatacaaccccattcgggcagcaaagagtttttaaggagaaagtggacacaaggactccccggccgatgcctggaacccgcaaggtaatggagattacggccgaatggttatggagaaccctgggtaggaataaacgaccccggttgtgcacacgtgaggaattcactaagaaggtgagaaccaacgcagccatgggcgctgtctttacagaggaaaatcagtgggattctgccaaagcggcagtggaggacgaggaattctggaagctcgttgatcgcgagagggaactgcacaaactagggaagtgtggaagctgcgtgtacaacatgatgggcaaacgggagaagaaacttggtgagtttgggaaggccaagggatcaagagctatctggtatatgtggctgggcgcccgctacctcgaattcgaggcactgggctttttgaatgaagaccattggttctccagggagaacagttacagcggggtcgaaggagagggtctgcacaaactcggctatattcttcgagatatctctaagataccagggggagctatgtacgccgacgatactgctggctgggacacccggatcacggaggacgatctgcacaatgaagagaaaattacacagcagatgaaccctgaacatagattactggccaatgcaatctttaagttgacctatcaaaacaaagtggtaaaggttcagaggcccactccaacaggtaccgtgatggacattatctcccgcaaggatcagcgtgggtcaggacaggtcggcacttacggcctcaataccttcacaaacatggaggcgcaactggtgcggcagatggaaggggagggagtgctaagcaaagccgaccttgagaacccccacctgcctgaaaagaaaataacgcagtggctcgagaccaagggtgtcgaaagactgaaaaggatggctatttcgggcgatgactgcgttgtgaagccaatcgatgaccgctttgccaatgcattgttagctctgaacgatatggggaaggtacgaaaagacatcccgcagtggcaaccctctaagggatggcatgattggcagcaggtgcctttctgtagtcaccactttcatgagctcattatgaaagacggccggaagcttgtcgtgccatgcagaccccaggatgaactgataggtagggcccgcatctcccaaggggcaggatggagcctaagagagactgcctgtctgggcaaagcgtatgctcagatgtggtcactcatgtacttccaccggagggacttgcgtctggcctccaatgcaatttgctctgccgttcctgtgcattgggtcccaacaagccgaaccacttggagtatccacgctcatcaccagtggatgacaaccgaggacatgcttacggtgtggaaccgcgtatggattgaagataatccctggatggaggacaagacacctgttaccacttgggaaaacgtgccgtatctgggcaagagagaggatcaatggtgtgggtccctcatcggattaaccagccgggccacatgggcacagaatatatctactgctatccagcaggtcaggtcactgattggtaacgaggaattcttggactacatgccaagtatgaaacgctttagaaaggaggaagagtccgaaggcgccatctggtga

SEQ ID NO: 15657 - RNA, 9873 nt, synthetic construct
  misc_feature 1..9873: note = derived and/or modified CDS sequence (opt3) from DENV-3__AY858043__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagagcacaaacgtggatgtccgccgagggggcttggaggcaggcagaaaaagtcgagacttgggccctccggcatcctggattcaccatcctggctctgtttctcgcccactacattggcacatctttaactcagaaggtggttatcttcatactgcttatgttggtgaccccatcgatgacaatgcgctgtgtcggcgtggggaacagagactttgtagaaggactgtcaggtgcgacctgggttgatgtggtcctagagcatggcgggtgcgtgacgactatggcaaagaataaacccacactcgacatcgagctgcagaagaccgaagccactcaacttgctacactgaggaaattgtgtattgagggaaagatcaccaacgtgacgaccgatagccggtgccctacacagggcgaagccattctcccagaggaacaggaccagaattatgtctgtcgccacacttacgttgatcgaggttgggggaacggatgcggcctgttcggcaaagggagtttagtgacctgcgcaaagtttcaatgtctggagctcatcgagggaaaggtagtgcagcacgaaaatcttaaatatacagtcataattactgtgcataccggtgaccagcaccaggttggcaacgagacacaaggggtgaccgctgaaatcactccccaggcctccacggtcgaggcgattctgcctgaatacggaacattgggcctagagtgctctccaagaaccggtctggacttcaatgagatgatcctcctgactatgaagaacaaagcctggatggtgcataggcagtggtttttcgatcttccgctgccctggaccagcggggcaacaaccgaaactcctacatggaataagaaagagttgctcgtaacgtttaagaacgctcacgccaaaaagcaagaagttgtggtcctgggctcccaggagggagctatgcacaccgccttaactggcgcaacagaaatccagacctcagggggaacaagtattttcgccggtcatctgaagtgtcggctaaaaatggacaagctcgagctgaaaggcatgagctatgctatgtgctctaatgcgtttgtgcttaagaaagaggtctccgaaactcagcacgggaccatattgatcaaggtggagtacaagggagaagatgcaccatgtaaaattcccttctcaacggaggacggccaaggtaaggttcataacgggcgtctgatcaccgccaaccctgtggtaacaaaaaaggaggaaccagtcaatatagaggctgaacccccgttcggcgagagcaacattatcatcggaattggcgataaagccctcaagatcaattggtacaagaaagggagttctattggaaagatgtttgaagcaactgcccgcggtgctagaaggatggccatactgggcgacaccgcatgggatttcgggtccgtgggaggcgttcttaacagcctgggtaaaatggtgcaccagatctttgggtcggcgtatacagctttgttctctggcgtctcctggattatgaagatcggaatcggcgtgctcctgacttggattgggttaaattcaaaaaacaccagtatgagcttttcctgcatagtaatcggaattatcacgctgtacctaggcgccgtggttcaggcagacatgggttgtgtcattaattggaaggggaaggagctcaaatgcggatctggcatcttcgtgacaaacgaggtgcatacctggactgaacagtataagtttcaagccgatagccctaaacggctggctacagccatagcaggtgcttgggagaatggcgtctgtgggatccgatcaaccactcgcatggaaaaccttttgtggaagcagattgccaatgagctgaactacatcctctgggaaaataacattaaactgaccgttgtggtgggagacatcataggcgtattagagcaggggaagagaacactgacgccccagccaatggagcttaaatatagttggaagacctggggaaaggcgaaagtcgtgactgccgaaattcaaaattccagcttcatcattgatggccctaacacacccgagtgcccaaacgcttctagggcatggaatgtttgggaagtggaggactacggttttggggtcttcaccacaaacatctggttgaagctccgggaaatgtatactcagctgtgtgaccaccgcctaatgtcagccgctgtgaaagatgagagagccgttcacgcagacatgggatactggatagagagtcagaagaatggcagctggaaactggaaaaggcgtccctcatcgaggtgaagacctgcacgtggcccaaatctcatacactgtggtcgaacggtgtacttgaaagcgatatgattatccctaagtccttggccggcccaatttcacagcacaattacaggccggggtatcatacccaaactgctggaccctggcacctgggcaaattagagctcgactttaactactgcgaggggaccacagtcgtgatcactgaaaattgtggaacccgtggccctagtctgcggacaacgaccgtgtctggtaagcttatacacgagtggtgctgtcgaagctgcactctgccacccttgagatatatgggggaagatggatgttggtacggcatggagattaggcctatcaacgaaaaagaggagaatatggtcaagtccctcgtttcagccggtagcggcaaggtggacaacttcacaatgggggtactgtgcctagcaatcctgtttgaagaggtgatgcgcggaaaattcggcaagaaacatatgattgctggggtcctcttcatgtttgtgctgcttttgtctggacagatcacctggcgggatatggccagaactctgattatgataggctccaatgcaagtgacaggatgggtatgggggttacatatttagccctcatcgctaccttcaagattcagccatttctggcgcttggattctttctgcgcaaactaacgagccgagaaaacctcctgttgggcgtgggcctggccatggcaactaccttacaactccccgaggatatcgaacagatggctaatgggattgccctgggacttatggccctgaagttgatcacacagttcgagacctaccagctctggactgctctggtctctctaacatgttccaacaccatatttacactgactgtggcatggcggaccgccacgcttatcctcgcgggtatttcactgttgccggtttgccaaagtagctcgatgcgtaagacagactggctgcctatgaccgtggctgccatgggcgtcccacccttacctctcttcatcttttccctgaaagatactcttaagagaaggtcttggcccctgaatgagggggtaatggcagtgggattggttagcattctcgcctcaagtctgctacgcaacgacgtgccaatggctggccctctggtcgcaggtgggcttctcatcgcctgttatgtgataaccggaacatccgcggatctgactgtagaaaaagctgccgacgtgacctgggaggaagaggcagaacagacgggcgtctctcacaacttgatgattacagttgacgatgacggcaccatgcggatcaaggatgacgagactgagaatatcttaacagtgctgctcaaaaccgccctgcttattgtgagcgggatattcccctactccatcccagctactctgttggtctggcatacatggcagaagcagacccaaagatcaggagtgctatgggatgttccgagccctcccgaaacgcagaaagccgagctggaagagggtgtatacaggattaagcagcagggcatctttgggaagactcaagtgggagtcggcgtgcagaaagagggtgttttccacaccatgtggcatgtgacacgaggggcagtcctcacctataacggaaagcgcctggaaccaaattgggctagtgtgaaaaaggaccttatttcttacggcggcgggtggcggttatccgcccagtggagaaaaggagaggaagtacaagtcatcgcggtggagcccggtaagaaccctaagaattttcagacaatgccaggcatattccagactaccacgggggaaatcggagccattgcactggatttcaaacccggcacaagcggttcgcctatcattaacagggaggggaaggttgtgggactctatggcaatggcgtcgtgactaaaaacgggggatacgtttcaggtatcgctcagaccaatgccgagccggacggcccaacacccgaattggaggaagagatgtttaagaaacgtaacctgaccataatggatctccaccctgggtctggaaagactcgcaagtatctgccagctattgtgcgggaagcaatcaaaagaaggcttcgaaccctgatcttggcccccacacgggtcgtggccgctgagatggaggaagcgctaaagggcctgcctattcgctaccaaacgactgcaaccaaaagtgagcacacaggtaaggaaatcgtagacctcatgtgccatgccaccttcactatgagattactgtccccggtgagggttcccaattataaccttataattatggatgaggctcactttacagacccagccagcatcgcagcccgggggtacatttctacccgagtcggaatgggcgaagctgcggccatcttcatgacggcaactcctcccggcacagctgatgcctttccacagagcaatgcacctatacaggacgaggagagagacattcccgaacgctcctggaactcagggaatgattggatcaccgacttcgccggaaaaaccgtgtggtttgtgccaagtatcaaggctggtaacgatattgccaactgtctgaggaagaatggcaaaaaggtcatccagctcagccgtaaaactttcgacacagagtaccaaaagaccaaattgaacgattgggactttgtagtgacaactgatatttctgaaatgggggcgaatttcaaggcagaccgggttatagatccgagaaggtgcctgaagcctgtgatcctcacggacggacccgagcgcgtcattctggccggcccaatgcccgtgaccgttgcttccgccgctcagcgaagaggtcgggtggggaggaaccctcagaaagagaatgatcagtatatctttacaggccaaccacttaacaatgacgaagaccatgcacactggactgaggccaagatgctactggataacatcaatacccccgaaggaattatacctgctttgttcgagccggaacgcgagaaatcagccgcaatcgacggcgagtaccgtttaaagggggaaagtagaaaaacattcgtcgagctgatgcggaggggagatctcccagtgtggctggcgcataaggtagccagcgaaggtattaaatataccgaccgcaagtggtgctttgatggcgagcgaaacaatcagatccttgaagagaacatggacgtggagatttggactaaggaaggggagaaaaagaaactgagaccccggtggctcgatgctaggacgtactccgaccctttggccctgaaggaattcaaagattttgcagctggacgcaagtctatcgccctagacctggttaccgagataggcagagtcccctcgcacctcgcacacaggacacggaatgcccttgataacctggtgatgttacatactagcgaacacggtgggcgtgcttatcgccatgcggtggaggagttgccagaaaccatggagacattcctgctcctgggccttatgatcctgctcaccggaggcgccatgttgtttctgatttcagggaagggagtcggtaaaacttccatcggcttaatttgtgttgtggcaagttctgggatgctatggatggctgacatccctctgcagtggatagccagcgccattgtactcgaattctttatgatggtgcttctgatccccgagccagagaagcagcgaacacctcaagataatcagttggcatacgtcgtgattggaatcctgacgctcgctgccatagttgcggctaacgaaatgggcctgcttgagaccactaaaagagacctcggtatgtccaaggaaccgggggtggtctcacccacatcttatctggacgtagatttgcacccagccagcgcatggaccctgtacgccgtggctaccacagttatcactcctatgttaaggcacacgattgagaatagtaccgcaaacgtgtccctagccgcgatcgctaaccaggccgtcgtgctgatgggcctcgacaaaggatggcccattagcaagatggatcttggcgtcccactgttggcactggggtgctactctcaagtgaatcctctcacactgactgccgctgttcttttactggtgacccattatgccatcataggacccggcctccaggcaaaggctacacgggaagcccagaaacgcaccgcggccggtattatgaagaacccgactgtagacgggatcatgacgatcgatttggacccagtgatttacgattcaaaattcgagaagcagctgggacaagtcatgctactggttctctgtgcagtgcagcttctgttgatgagaacatcctgggctttttgcgaggccctgaccctcgcaactggccctatcaccacactgtgggaaggtagtcccggcaaattctggaatactaccatagctgtcagcatggccaacatttttagggggtcgtatttagccggagcgggccttgctttctctatcatgaagtccgtggggacaggaaagcggggcacgggtagccagggggagaccctgggagaaaaatggaagaaaaagctcaatcagctatcacgaaaagagtttgacctgtacaagaaaagtggcattactgaagtagatagaacagaggcaaaggagggtttgaagcgcggcgaaaccactcaccatgccgtgtctagggggtccgctaaactgcaatggttcgttgagcggaacatggtgatcccagaaggacgtgtcatagacctcggctgtgggagaggaggctggagctattactgcgccggtcttaagaaagtgacagaggtcagggggtataccaagggaggccccggccacgaagagcctgtgccgatgtcaacgtacgggtggaatatcgttaaactgatgagtggaaaggatgtattctacttgcccccagagaagtgtgacaccctgctctgcgatattggtgaaagctccccttctcccacagtggaggaaagccgcactatccgggtcttaaaaatggtggagccttggctgaagaacaatcagttttgtattaaagttcttaacccatatatgcccaccgtgatcgagcatctggaacgactacagagaaagcacggcgggatgctcgtcaggaatcctctgtcccgcaactcaacacacgagatgtactggatttctaatggaactggcaacatcgtgagttcggtaaatatggtgagccggttgctgctcaacagattcaccatgacatatcgtaggccaaccatagaaaaagacgttgaccttggtgcagggactcggcatgtcaacgccgagcccgaaacgccgaatatggatgtgattggagagcgcatccgaagaatcaaggaggaacactcctctacatggcattacgacgatgagaacccttataagacctgggcttaccacggctcatatgaagtgaaagcgactggcagcgcctccagtatgattaatggggtcgttaagctgttaaccaaaccatgggacgtggtacccacagtgacgcagatggcaatgaccgatactacaccttttggacaacagagggtcttcaaggagaaagtggacacccggactccaaagcccatgccgggtacacgcaaggttatggaaataaccgctgagtggctgtggagaacattgggcaggaacaaacgacctcggctctgcactcgtgaggaatttaccaagaaagtgagaacgaatgccgcaatgggggccgtcttcaccgaggaaaaccagtgggattctgctcgcgccgcggtggaggacgaagagttttggaagctggtagatagggagcgggaactacacaaacaaggaaagtgtggcagctgcgtttacaatatgatgggtaaaagagagaagaagcttggggaattcggaaaagcaaagggctcacgcgccatctggtacatgtggctgggcgctaggtatctcgagtttgaggccctggggttcttgaacgaagaccattggttttcccgagagaatagttacagcggagtggaaggtgagggcctgcacaaactcgggtatattcttcgggatatctctaagattcccggaggcgcaatgtacgctgacgacacagccggttgggatactagaatcaccgaagacgatctgcataacgaggagaaaataacacagcagatggacccagaacacaggcagttagctaatgccatcttcaagctgacttatcaaaacaaggtcgtgaaagtgcagcgccctacccccaaggggacggtcatggatattatctcccgtaaagaccagcggggatcaggccaggttggcacatacgggttgaatacctttactaacatggaggcacaactcattagacagatggaaggagagggtgtgctgagcaagacagatctagaaaatccacatcttctggagaaaaagatcatacagtggctcgagaccaagggcgtagaaaggctgaaacgcatggcgatttcgggggacgattgcgtggtcaagcccatcgacgatcgattcgccaacgctttgttagccctgaacgacatgggaaaagtgcggaaggatatccctcagtggcaaccatctagaggctggcacgactggcagcaggttccgttctgtagtcaccattttcacgagctcattatgaaagacggtaggaagcttgtggtcccctgccgccctcaggatgaactgatagggagagcacggatctcccaaggagctggctggagcctaaaggagactgcctgtctgggcaaagcatatgcccagatgtgggcgctcatgtacttccataggcgtgacttgcgactggcttcaaatgccatttgctccgcagtgccagtacactgggttcccacctctcgcacaacgtggagcatccacgcccatcaccagtggatgaccactgaagatatgcttacagtgtggaacagagtctggattgaggacaatccttggatggaggataagaccccagtgactacatgggaagacgttccctacctggggaaacgggaggatcaatggtgtggaagtctcatcggtttaacctccagggctacgtgggcccagaacatactgacagcaatccagcaggtgcgcagcttgattggcaatgaagagtttctggactatatgccttctatgaagagattccggaaagaggaagagtcagaaggggctatctggtga

SEQ ID NO: 15658 - RNA, 9873 nt, synthetic construct
  misc_feature 1..9873: note = derived and/or modified CDS sequence (opt3) from DENV-3__AY858044__SS-prME
  source 1..9873: mol_type = other RNA
accagcctgtgcctcatgatgatgcttcccgcaacactggctttccacttgacttccagagacggcgagcctagaatgatcgtggggaagaacgaacggggaaaatctttactgtttaagacggcatcaggtattaatatgtgtaccctgatagccatggatctcggcgagatgtgcgacgatacaatcacttacaaatgtccactgattaccgaagtcgagccggaagacatcgattgctggtgtaaccttacaagtacctgggttacttatgggacatgcaatcaggcgggagagcatcgccgagacaagcgtagcgtggctctggcaccccacgtaggcatgggtttggataccagagcacaaacgtggatgtccgccgagggggcttggagacaggtggaaaaagtcgagacttgggcattccggcatcctggatttaccattctcgccctgttcctggctcactacatcggcacatctctcactcagaaggtggttatatttatcttactgatgcttgtgaccccatcgatgacaatgcgctgtgtcggcgtggggaacagagacttcgtagaaggattgtcaggtgccacctgggttgatgtggtcctggagcatggcgggtgcgtgacgactatggcgaagaataaacccacactagacattgagctccagaagaccgaagcaactcaactggccacacttaggaaactgtgtatcgagggaaagattaccaacgtgacgaccgatagccggtgccctacacagggcgaagctatcttgccagaggaacaggaccagaattatgtctgtaaacacacttacgttgatcgcggttgggggaacggatgcggcctctttggcaaggggagtctggtgacctgcgccaagttccaatgtttagagctgatagagggaaaagtagtgcagcacgaaaatctcaagtatacagtcattatcactgtgcataccggtgaccagcaccaggttggcaacgagacacaaggggtgaccgcagaaattactccccaggcttccacggtcgaggccatccttcctgaatacggaacactgggcttggagtgctctccacgaaccggtctagactttaatgagatgatcctgctcactatgaaaaacaaggcgtggatggtgcatagacagtggttctttgatctgccgcttccctggaccagcggggccacaaccgaaactcctacatggaataaaaaggagctgttggtaacgttcaaaaacgcacacgctaagaagcaagaagttgtggtcctcggctcccaggagggagccatgcacaccgctctgactggcgccacagaaattcagacctcagggggaacaagtatatttgcaggtcatttaaaatgtaggctgaagatggacaaactagagctcaagggcatgagctatgccatgtgctctaatgctttcgtgctgaaaaaggaggtctccgaaactcagcacgggaccatccttattaaggtggagtacaaaggagaagatgcgccatgtaagatccccttctcaacggaggacggccaaggtaaagcacataacgggcggttgataaccgccaaccctgttgtgacaaagaaagaggaaccagtaaatattgaggctgaacccccgtttggcgagagcaacatcatcattggaatcggcgataaggccctgaagattaattggtacaaaaaggggagttctataggaaaaatgttcgaagcaactgcccgtggtgctcgcagaatggccatcctcggcgacaccgcatgggattttgggtccgtcggaggcgtgctgaacagccttggtaagatggttcaccagattttcgggtcggcgtatacagctctgttttctggcgtgtcctggatcatgaaaatcggaattggcgtcttgctcacttggatagggctaaattcaaagaacaccagtatgagcttctcctgcatcgtgattggaatcattacgttatacctgggcgccgtagtgcaggcagacatgggttgtgttatcaattggaaggggaaagagctaaagtgcggatctggcatatttgtcacaaacgaggtgcatacctggactgaacagtataaattccaagccgatagccctaagaggctcgctacagccatcgccggtgcttgggagaatggcgtgtgtgggattcggtcaaccactcgaatggaaaacctgctttggaaacagatcgccaatgagttgaactacattctgtgggaaaataacatcaagctcaccgtcgttgtgggagacataattggcgtgctggagcaggggaaacgcacattaacgccccagccaatggagctgaagtatagttggaagacctggggaaaagcgaagatcgtaactgccgaaattcaaaattccagctttatcatagatggccctaacacacccgagtgcccaaacgcttctagagcatggaatgtctgggaagtggaggactacggtttcggggtttttaccacaaacatctggcttaaattgagggaaatgtatactcagctctgtgaccaccggctgatgtcagccgctgtgaaggatgagcgcgccgtccacgcagacatgggatactggattgagagtcagaaaaatggcagctggaagctagaaaaggcgtccctgatcgaggtgaaaacctgcacgtggcccaagtctcatacactctggtcgaacggtgttctggaaagcgatatgattatccctaaatcccttgccggcccaatatcacagcacaattacagaccggggtatcatacccaaactgctggaccctggcacttgggcaagctggagttagacttcaactactgcgaggggaccacagtggtaattactgaaaattgtggaaccaggggccctagtctccgtacaacgaccgtctctggtaaactgatccacgagtggtgctgtcggagctgcactcttccacccctgcgatatatgggggaagatggatgttggtacggcatggagatcagacctattaacgaaaaggaggagaatatggtgaagtccttggtgtcagccggtagcggcaaagtcgacaactttacaatgggggttctctgcctggcaatcctattcgaagaggtgatgaggggaaagttcggcaaaaagcatatgattgctggggtactgtttatgttcgtgctcctgctttctggacagataacctggcgcgatatggcccggactttgatcatgattggctccaatgcaagtgacagaatgggtatgggggtcacatatctggccttaatcgctacctttaaaattcagccattcctcgcgctgggatttttccttaggaagctgacgagccgcgaaaacctactcctgggcgtgggcttggccatggcaactaccctgcaattacccgaggatatcgaacagatggctaatgggatagccctcggactgatggcccttaagctgatcacacagtttgagacctaccagttgtggactgctctcgtttctctgacatgttccaacaccattttcacactaactgtggcatggcgaaccgccacgctgatccttgcgggtatttcactcctgccggtctgccaaagtagctcgatgcggaaaacagactggttgcctatgaccgtggctgccatgggcgttccacccctgcctttatttatcttctccctcaaggatactctgaaacgtagatcttggccccttaatgagggggtgatggcagtcggactggtaagcatattggcctcaagtctcctgaggaacgacgtgccaatggctggccctctagttgccggtgggctgcttattgcctgttatgtgatcaccggaacatccgcggatctcactgtcgaaaaggctgccgacgtgacctgggaggaagaggcagaacagacgggcgtatctcacaacctgatgatcacagtggacgatgacggcaccatgcgcattaaagatgacgagactgagaatatattgacagtcttactgaagaccgccctcctgatcgttagcgggatttttccctactccatcccagctactcttctggtgtggcatacatggcagaaacagacccaacggtcaggagtgttgtgggatgtcccgagccctcccgaaacgcagaaggccgagctagaagagggtgtgtacagaattaagcagcagggcatcttcgggaaaactcaagttggagtaggcgtgcagaaggagggtgtctttcacaccatgtggcatgtgacaagaggggcagttctgacctataacggaaaacgactcgaaccaaattgggctagtgtgaagaaagacctgatatcttacggcggcgggtggcgcctttccgcccagtggcaaaagggagaggaagtccaggtgatcgcggtagagcccggtaagaaccctaaaaatttccagacaatgccaggcattttccagactaccacgggggaaatcggagccattgcattagattttaagcccggcacaagcggttcgcctatcataaaccgggaggggaaagtcgtgggactgtatggcaatggcgttgtgactaagaacgggggatacgtctcaggtattgctcaaaccaatgccgagccggacggcccaacacccgaactcgaggaagagatgttcaaaaagagaaacttgaccatcatggatctgcaccctgggtctggaaagactaggaaatatctcccagctatcgtgcgtgaagcaattaagcgccggctgagaacccttatcctggcccccacaagggttgtggccgctgagatggaggaagcgttgaaaggcctacctatacgataccagacgactgcaaccaagagtgagcacacaggtaaagaaattgtcgacctgatgtgccatgccacctttactatgcggctcttatccccggtgcgcgtacccaattataacctgatcattatggatgaggctcacttcacagacccagccagcatcgcagccagagggtacatatctaccagggtgggaatgggcgaagctgcggccatttttatgacggcaactcctcccggcacagctgatgccttcccacagagcaatgcacctatccaggacgaggagcgggacatccccgaacgatcctggaactcagggaatgattggattaccgactttgccggaaagaccgtttggttcgtcccaagtatcaaggctggtaacgatattgccaactgtcttaggaagaatggcaagaaagtgatacaactgagccgcaagacttttgacacagagtaccagaaaaccaagctcaacgattgggacttcgtggtcacaactgatatctctgaaatgggggcgaattttaaggcagacagggtaattgatccgcgtcggtgcttgaaacctgtgatcctgacggacggacccgagagagttatcctcgccggcccaatgcccgtgaccgtcgcttccgccgctcagaggcgcggtcgagtggggagaaaccctcagaaggagaatgatcaatatattttcacaggccagccactgaacaatgacgaagaccatgcacactggactgaggccaaaatgcttctagataacataaatacccccgaaggaatcattcctgctctgttcgagccggaacgggagaagtcagccgcaatcgacggcgagtacaggttgaaaggggaaagtcgcaagacatttgttgagttaatgcgtagaggagatctgccagtgtggctcgcgcataaagtcgccagcgaaggtattaagtataccgaccggaagtggtgcttcgatggcgagaggaacaatcagatcctggaagagaacatggacgtggagatatggactaaagaaggggagaagaagaaacttcgcccccgatggctggatgctagaacgtactccgaccctctcgccttgaaagaatttaaagatttcgcagctggacggaagtctatcgccctggacctagtaaccgagattggcagggtgccctcgcacctggcacaccgcacaagaaatgccctcgataaccttgttatgctgcatactagcgaacacggtgggagggcttatcggcatgcggtcgaggagttaccagaaaccatggagacattgctgctcctgggccttatgatcctgctcaccggaggcgccatgttgtttctgatttcagggaaaggagtgggtaagacttccatcggcttaatatgtgtggtcgcaagttctgggatgctatggatggctgacattcctctgcagtggatcgccagcgccattgttctcgagttctttatgatggtgcttctgatccccgagccagagaaacaacgtacacctcaggataatcagttggcatacgtagtgataggaatcctgacgctcgctgccattgtcgcggctaacgaaatgggcctgcttgagaccactaagcgcgacctcggtatgtccaaagaaccgggggtggtttcacccacatcttatctggacgtggatttgcacccagccagcgcatggaccctgtacgccgtcgctaccacagtaatcactcctatgttacgacacacgattgagaatagtaccgcaaacgtgtccctagccgcgatcgctaaccaagccgttgtgctgatgggcctcgacaagggatggcccataagcaagatggatcttggcgtcccactgttggcactggggtgctactctcaggtgaatcctctcacactgactgccgctgtccttttactggtgacccattatgccattatcggacccggcctccaggcaaaagctacaagagaagcccagaagaggaccgcggccggtatcatgaaaaacccgactgttgacgggattatgacgatcgatttggacccagtgatatacgattcaaagttcgagaaacaactgggacaggtaatgctactggtgctctgtgcagtccagcttctgttgatgcggacatcctgggctttttgcgaggccctgaccctcgcaactggccctattaccacactgtgggaaggtagtcccggcaagttctggaatactaccatcgctgttagcatggccaacatttttcgcgggtcgtatttagccggagcgggccttgctttctctatcatgaagtccgtggggacaggaaaaagaggcacgggtagccagggggagaccctgggagaaaagtggaaaaagaaactcaatcaactatcaaggaaggagtttgacctgtacaaaaagagtggcataactgaagtcgatcggacagaggcaaaggagggtttgaaacgaggcgaaaccactcaccatgccgtgtctagagggtccgctaagctgcagtggttcgtagagcgcaacatggtgatcccagaaggaagggttattgacctcggctgtgggcggggaggctggagctattactgcgccggtcttaaaaaggtgacagaggtccgtgggtataccaaaggaggccccggccacgaagaacctgtgccgatgtcaacgtacgggtggaatatcgtcaagctgatgagtggaaaggatgtgttctacttgcccccagagaaatgtgacaccctgctctgcgatattggtgaaagctccccttctcccacagttgaggaaagcagaactatcagggtattaaagatggtggagccttggctgaaaaacaatcagttttgtattaaggtccttaacccatatatgcccaccgtgatcgagcatctggaacgcctacagcggaaacacggcgggatgctcgttcgaaatcctctgtccagaaactcaacacacgagatgtactggatatctaatggaactggcaacattgtgagttcggtcaatatggtgagcaggttgctgctcaaccgcttcaccatgacatatcggagaccaaccatcgaaaaggacgtagaccttggtgcagggactcgtcatgtgaacgccgagcccgaaacgccgaatatggatgttatcggagagaggattcggcgcataaaggaggaacactcctctacatggcattacgacgatgagaacccttataaaacctgggcttaccacggctcatatgaagtcaaggcgactggcagcgcctccagtatgatcaatggggtggtgaaactgttaaccaagccatgggacgtcgttcccacagtgacgcaaatggcaatgaccgatactacaccttttggacagcagcgagtattcaaagagaaggtggacaccagaactccaaagcccatgccgggtacaaggaaagtcatggaaattaccgctggctggctgtggcggacattggggcgcaacaagagacctaggctctgcactcgagaggagtttaccaaaaaggtgcggacgaatgccgcaatgggagccgttttcaccgaagagaaccaatgggattctgctcgtgccgcggtggaagacgaggaattttggaaactggtcgatagagagcgcgagctacacaagcagggcaaatgtggtagctgcgtgtacaatatgatggggaagagggaaaagaaacttggagagttcggcaaggcaaaaggctcacgggccatctggtacatgtggctgggggctagatatctcgaatttgaggccctgggattcttgaacgaggaccattggttttcccgcgaaaatagttacagcggtgtagagggcgaagggctgcacaagctcggatatattcttagggatatctctaaaatacccggcggtgcaatgtacgctgacgacacagccgggtgggatactcgaatcaccgaggacgatctgcataacgaagagaagattacacagcagatggacccagagcaccggcaattagctaatgccatcttcaagctgacttatcagaacaaagttgtgaaggtccagagacctacccccaaaggaacggtgatggatattatctccaggaaggaccagcgcggctcaggccaagtggggacatacggattgaatacctttactaacatggaagcacagctcatacgtcagatggagggtgaaggcgtcctgagcaaaacagatctagagaatccacatcttctggaaaagaagattacccagtggctcgagactaaaggggttgagcggctgaagagaatggcgatctcgggagacgattgcgtggtaaaacccatcgacgataggttcgccaacgctttgttagccctgaacgacatgggcaaggtgcgcaaagatattcctcaatggcagccatctaagggttggcacgactggcagcaggtcccgttctgtagtcaccattttcacgaactcataatgaaggacgggcgaaaacttgtggttccctgccggcctcaagatgagctgatcggaagggcaaggatttcccagggcgctggctggagcctaaaggaaaccgcctgtctggggaaagcatatgcccagatgtgggcgctcatgtacttccatcgcagagacttgcggctggcttcaaatgccatctgctccgcagtgccagtccactgggtgcccacatctaggacgacctggagcattcacgcccatcaccaatggatgactacagaggatatgcttaccgtatggaaccgtgtttggatcgaagacaatccttggatggaggataagactccagtgacaacctgggaggacgtcccctacctgggaaaacgagaagatcagtggtgtggtagtctcataggcttaacgtcccgcgctacatgggcccagaacatcctgaccgcaattcagcaagtgaggagcttgatcgggaatgaggaatttctggactatatgccttctatgaagcggttcaggaaggaggaggaatcagagggagctatttggtga

SEQ ID NO: 15659 - RNA, 9873 nt, synthetic construct
  misc_feature 1..9873: note = derived and/or modified CDS sequence (opt3) from DENV-3__AY858045__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacaatcacttacaaatgtccactgattaccgaagtcgagccggaagacatcgattgctggtgtaaccttacaagtacctgggttacttatgggacatgcaatcaggcgggagagcatcgccgagacaagcgtagcgtggctctggccccccacgtaggcatgggtttggataccagagcacaaacgtggatgtccgccgagggggcttggaggcaggtggaaaaagtcgagacttgggcattccggcatcctggatttaccattctcgccctgttcctggctcactacatcggcacatctctcactcagaaggtggttatatttatcttactgatgcttgtgaccccatcgatgacaatgcgctgtgtcggcgtggggaacagagacttcgtagaaggattgtcaggtgccacctgggttgatgtggtcctggagcatggcgggtgcgtgacgactatggcgaagaataaacccacactagacattgagctccagaagaccgaagcaactcaactggccacacttaggaaactgtgtatcgagggaaagattaccaacgtgacgaccgatagccggtgccctacacagggcgaagctatcttgccagaggaacaggaccagaattatgtctgtaaacacacttacgttgatcgcggttgggggaacggatgcggcctctttggcaaggggagtctggtgacctgcgccaagttccaatgtttagagctgatagagggaaaagtagtgcagcacgaaaatctcaagtatacagtcattatcactgtgcataccggtgaccagcaccaggttggcaacgagacacaaggggtgaccgcagaaattactccccaggcttccacggtcgaggccatccttcctgaatacggaacactgggcttggagtgctctccacgaaccggtctagactttaatgagatgatcctgctcactatgaaaaacaaggcgtggatggtgcatagacagtggttctttgatctgccgcttccctggaccagcggggccacaaccgaaactcctacatggaataaaaaggagctgttggtaacgttcaaaaacgcacacgctaagaagcaagaagttgtggtcctcggctcccaggagggagccatgcacaccgctctgactggcgccacagaaattcagacctcagggggaacaagtatatttgcaggtcatttaaaatgtaggctgaagatggacaaactagagctcaagggcatgagctatgccatgtgctctaatgctttcgtgctgaaaaaggaggtctccgaaactcagcacgggaccatccttattaaggtggagtacaaaggagaagatgcgccatgtaagatccccttctcaacggaggacggccaaggtaaagcacataacgggcggttgataaccgccaaccctgttgtgacaaagaaagaggaaccagtaaatattgaggctgaacccccgtttggcgagagcaacatcatcattggaatcggcgataaggccctgaagattaattggtacaaaaaggggagttctataggaaaaatgttcgaagcaactgcccgtggtgctcgcagaatggccatcctcggcgacaccgcatgggattttgggtccgtcggaggcgtgctgaacagccttggtaagatggttcaccagattttcgggtcggcgtatacagctatcttttctggcgtgtcctggatcatgaaaattggaataggcgtcctgttgacttggatcgggctcaattcaaagaacaccagtatgagcttctcctgcattgtgatcggaattatcacgctgtacttaggcgccgtagtgcaggcagacatgggttgtgttataaattggaaggggaaagagctgaagtgcggatctggcatctttgtcacaaacgaggtgcatacctggactgaacagtataaattccaagccgatagccctaagaggctagctacagccattgcaggtgcttgggagaatggcgtgtgtgggatccggtcaaccactcgaatggaaaacctcctgtggaaacagattgccaatgagcttaactacatcttgtgggaaaataacataaagctgaccgtcgttgtgggagacattatcggcgtgctcgagcaggggaaacgcacactgacgccccagccaatggagttaaagtatagttggaagacctggggaaaagcgaagattgtaactgccgaaatccaaaattccagctttataatcgatggccctaacacacccgagtgcccaaacgcttctagagcatggaatgtctgggaagtggaggactacggtttcggggtttttaccacaaacatttggctgaaacttagggaaatgtatactcagttgtgtgaccaccggctcatgtcagccgctgtgaaggatgagcgcgccgtccacgcagacatgggatactggatcgagagtcagaaaaatggcagctggaagctggaaaaggcgtccctaattgaggtgaaaacctgcacgtggcccaagtctcatacactgtggtcgaacggtgttctcgaaagcgatatgatcatacctaaatccctggccggcccaatttcacagcacaattacagaccggggtatcatacccaaactgctggaccctggcaccttggcaagttggagctggacttcaactactgcgaggggaccacagtggtaatcactgaaaattgtggaaccaggggccctagtttacgtacaacgaccgtctctggtaaactcatccacgagtggtgctgtcggagctgcactctgccaccccttcgatatatgggggaagatggatgttggtacggcatggagattagacctatcaacgaaaaggaggagaatatggtgaagtccctggtgtcagccggtagcggcaaagtcgacaactttacaatgggggttttgtgcctcgcaattctgttcgaagaggtgatgaggggaaagttcggcaaaaagcatatgatagctggggtactatttatgttcgtgctgctcctgtctggacagatcacctggcgcgatatggcccggactcttattatgatcggctccaatgcaagtgacagaatgggtatgggggtcacatatttggccctgattgctacctttgaaatccagccattcttagcgctcggatttttcctgaggaaacttacgagccgcgagaacctgctactcggcgtgggcctggccatggcaactaccttgcaactgcccgaagatatagagcagatggctaatgggatcgccttaggactcatggccctgaagcttattacacagtttgagacctaccagctgtggactgctttggtttctctcacatgttccaacaccatcttcacactgactgtggcatggcgaaccgccacgctaattctggcgggtatctcacttctcccggtctgccaaagtagctcgatgcggaagacagactggctgcctatgaccgtggctgccatgggcgttccacccttgcctctgtttatattctccttaaaagatactctcaagcgtagatcttggcccctgaatgaaggggtgatggcagtcggacttgtaagcattctggcctcaagtttgctcaggaacgacgtgccaatggctggccctctggttgcaggtgggctactgatcgcctgttatgtgatcaccggaacatccgcggatcttactgtcgagaaagctgccgacgtgacctgggaagaggaagcagagcagacgggcgtatctcacaacctcatgattacagtggacgatgacggcaccatgcgcataaaggatgacgagactgaaaatatcctgacagtcttgttaaaaaccgccctgctcattgttagcgggatctttccctactccattccagctactctgcttgtgtggcatacatggcagaagcagacccaacggtcaggagtgctgtgggatgtcccgagccctcccgagacgcagaaagccgaattggaggagggtgtgtacagaatcaagcagcagggcatattcgggaagactcaagttggagtaggcgtgcagaaagaaggtgtctttcacaccatgtggcatgtgacaaggggggcagttctaacctataacggaaagcgactggagccaaattgggctagtgtgaaaaaggacctcatctcttacggcggcgggtggcgcctgtccgcccagtggcaaaaaggagaagaggtccaggtgattgcggtagaacccggtaagaaccctaagaatttccagacaatgccaggcatcttccagactaccacgggggagattggagccatcgcacttgattttaaacccggcacaagcggttcgcctataattaaccgggaggggaaggtcgtgggattatatggcaatggcgttgtgactaaaaacgggggatacgtctcaggtatcgctcaaaccaatgccgaaccggacggcccaacacccgagctggaagaggaaatgttcaagaaaagaaacctcaccatcatggatttgcaccctgggtctggaaagactaggaagtatctgccagctattgtgcgtgaggcaatcaaacgccggctcagaaccctgatacttgcccccacaagggttgtggccgctgagatggaagaggcgctgaagggcttgcctattcgataccagacgactgcaaccaaaagtgaacacacaggtaaggagatcgtcgacctaatgtgccatgccacctttactatgcggctgctctccccggtgcgcgtacccaattataacttaattatcatggatgaagctcacttcacagacccagccagcatagcagccagagggtacatttctaccagggtgggaatgggcgaggctgcggccatctttatgacggcaactcctcccggcacagctgatgccttcccacagagcaatgcacctatccaggacgaggaacgggacattcccgagcgatcctggaactcagggaatgattggatcaccgactttgccggaaaaaccgtttggttcgtcccaagtattaaggctggtaacgatatagccaactgtctgagaaagaatggcaaaaaggtgatccaacttagccgcaaaacttttgacacagaataccagaagaccaaactgaacgattgggacttcgtggtcacaactgatatttctgagatgggggcgaattttaaggcagacagggtaatcgatccgcgtcggtgcctcaagcctgtgatcttgacggacggacccgagagagttattctggccggcccaatgcccgtgaccgtcgcttccgccgctcagaggcgcggtcgagtggggagaaaccctcagaaagaaaatgatcaatatatattcacaggccagccactcaacaatgacgaggaccatgcacactggactgaagccaagatgctgcttgataacatcaatacccccgagggaattatccctgctctattcgaaccggagcgggagaaatcagccgcaattgacggcgaatacaggctgaagggggagagtcgcaaaacatttgttgaattgatgcgtagaggagatttaccagtgtggctggcgcataaggtcgccagcgagggtatcaaatataccgaccggaagtggtgcttcgatggcgaaaggaacaatcagatactcgaggagaacatggacgtggaaatctggactaaggagggggaaaaaaagaaactgcgcccccgatggcttgatgctagaacgtactccgaccctctggccctcaaggagtttaaagatttcgcagctggacggaagtctattgccttggacctggtaaccgaaatcggcagggtgccctcgcacctagcacaccgcacaagaaatgccctggataacctcgttatgcttcatactagcgagcacggtgggagggcttatcggcatgcggtcgaggaactgccagagaccatggaaacattattgctgctcggcctgatgattcttctgaccggaggcgccatgctctttttgatctcagggaagggagtgggtaaaacttccataggcctgatttgtgtggtcgcaagttctgggatgttatggatggctgacatccctctacagtggattgccagcgccatcgttctggagttctttatgatggtgctccttatacccgagccagaaaagcaacgtacacctcaggataatcagctggcatacgtagtgatcggaattttgacgctggctgccatcgtcgcggctaacgagatgggcctcctggaaaccactaaacgcgaccttggtatgtccaaggagccgggggtggtttcacccacatcttatctcgacgtggatctgcacccagccagcgcatggaccttgtacgccgtcgctaccacagtaattactcctatgctgcgacacacgatcgaaaatagtaccgcaaacgtgtccttagccgcgatagctaaccaagccgttgtgctaatgggcctggacaaaggatggcccattagcaagatggatctcggcgtcccacttctggcattggggtgctactctcaggtgaatcctctgacactcactgccgctgtcctgcttttagtgacccattatgccatcatcggacccggcctgcaggcaaaggctacaagagaggcccagaaaaggaccgcggccggtattatgaagaacccgactgttgacgggatcatgacgatagatctcgacccagtgatttacgattcaaaattcgagaagcaattgggacaggtaatgctgctagtgctgtgtgcagtccagctccttctgatgcggacatcctgggctttttgcgaagccttgaccctggcaactggccctatcaccacactctgggagggtagtcccggcaaattctggaatactaccattgctgttagcatggccaacatctttcgcgggtcgtatctggccggagcgggcttagctttctctataatgaagtccgtggggacaggaaagagaggcacgggtagccagggggaaacccttggagagaaatggaagaaaaggctgaatcaactctcacggaaggaatttgacctatacaaaaagagtggcatcactgaggtcgatcgaacagaggcaaaagaaggtctgaagagaggcgagattacccaccatgccgtgtctcgcgggtccgctaagttgcagtggttcgtagaaaggaacatggtgatcccagagggacgggttattgacctgggctgtgggcgtggaggctggagctattactgcgccggtctcaaaaaggtgactgaagtcagagggtatacaaaaggaggccccggccacgaggagcctgtgccgatgtcaacctacgggtggaatatcgtcaagcttatgagtggaaaagatgtgttctacctgcccccagaaaagtgtgacacgttgctgtgcgatattggtgagagctccccttctcccaccgttgaagagagcaggacaatccgcgtactcaagatggtggagccttggttaaaaaacaatcagttttgtataaaggtcctgaacccatatatgcccactgtgattgaacatcttgagcggctgcagcgaaaacacggcgggatgctagttagaaatcctctctccaggaactcaacccacgaaatgtactggatctctaatggaacaggcaacatcgtgagttcggtcaatatggtgagccgcctgttgctgaaccggttcactatgacctatagacgtccaacaattgagaaggacgtagacctcggtgcagggaccaggcatgtgaacgccgaacccgagactccgaatatggatgttataggagagcggatccgccgaattaaagaagagcactcctctacgtggcattacgacgatgaaaacccttataagacatgggcttaccacggctcatatgaggtcaaggcgaccggcagcgcctccagtatgatcaatggggtggtgaaacttctgactaagccatgggacgtcgttcccaccgtgacacaaatggcaatgacggataccactccttttggacagcagagagtattcaaagaaaaggtggacacaaggaccccaaaacccatgccgggtactcggaaggtcatggagattacagctggctggttatggcgcaccctggggagaaacaagaggcctcgattgtgcacacgggaggaatttactaaaaaggtgcgtaccaatgccgcaatgggagccgttttcacggaggaaaaccaatgggattctgctagagccgcggtggaggacgaagagttttggaaactcgtcgatcgcgagagggaactgcacaagcagggcaaatgtggtagctgcgtgtacaatatgatggggaagcgggagaaaaagctaggagaattcggcaaggcaaaaggctcaagagccatctggtacatgtggcttggggctcgctatctggagtttgaggccctcggattcctgaacgaagaccattggttttccagggagaatagttacagcggtgtagaaggcgaggggttgcacaagctgggatatatactccgagatatctctaaaattcccggcggtgcaatgtacgctgacgacaccgccgggtgggatacacggatcactgaagacgatcttcataacgaggagaagattacccagcagatggacccagaacacagacaactggctaatgccatcttcaaattaacatatcagaacaaggttgtgaaggtccagaggcctactcccaaaggaaccgtgatggatataatttcccgcaaggaccagcgtggctcaggccaagtggggacgtacggactgaatacatttaccaacatggaggcacagttgatccggcagatggaaggtgagggcgtcctcagcaaaactgatctggaaaatccacatctacttgagaagaaaatcacacagtggctggagaccaagggggttgaaagactcaagaggatggcgatttcgggagacgattgcgtggtaaaacccatagacgatcgcttcgccaacgctctgttggccttaaacgacatgggcaaggtgcgaaaagatatccctcaatggcagccatctaagggttggcacgactggcagcaggtcccgttctgtagtcaccattttcacgagctgattatgaaagacgggcggaagctcgtggttccctgcagacctcaagatgaacttatcggaagggcacgcatttcccagggcgctggctggagcctgaaggagactgcctgtctagggaaagcatatgcccagatgtgggcgctgatgtacttccatagacgggacctcaggttggcttcaaatgccatctgctccgcagtgccagtccactgggtgcccacctctcgtacaacgtggagcatacacgcccatcaccaatggatgaccactgaagatatgctgacagtatggaaccgagtttggatcgaggacaatccttggatggaggataagaccccagtgactacatgggaagacgtcccctaccttggaaaacgcgaggatcagtggtgtggtagtctgattggcctcacctccagagctacgtgggcccagaacatcttaacagcaattcagcaagtgcggagcctgatcgggaatgaagagtttttggactatatgccttctatgaagaggttccgcaaagaggaagagtcagaaggagctatttggtga

SEQ ID NO: 15660 - RNA, 9873 nt, synthetic construct
  misc_feature 1..9873: note = derived and/or modified CDS sequence (opt3) from DENV-3__AY858046__SS-prME
  source 1..9873: mol_type = other RNA
accagcctgtgcctcatgatgatgcttcccgccacactggctttccacttgacttccagagacggcgaacctaggatgatcgtggggaagaacgaacggggaaaatctttactgtttaagacggcatcaggtattaatatgtgtaccctgatagccatggatctcggcgaaatgtgcgacgatacaatcacttacaaatgtccactgattaccgaagtcgagccggaagacatcgattgctggtgtaaccttacaagtacctgggttacttatgggacatgcaatcaggtgggagagcatcgccgagacaagcgtagcgtagcgctggctccccacgtgggcatgggtttggataccagagcccagacgtggatgtccgcagagggggcctggaggcaggtcgaaaaagtggagacttgggctttccggcatcctggatttaccattctcgcactgttcctggcccactacatcggcacatctctcactcagaaggttgtgatatttatcttactgatgcttgtcaccccatcgatgacaatgcgctgtgtgggcgtagggaacagagacttcgttgaaggattgtcaggtgctacctgggtggatgtcgtgctggagcatggcgggtgcgtgacgactatggccaagaataaacccacactagacattgagctccagaagaccgaagcgactcaactggcaacacttaggaaactgtgtatcgagggaaagattaccaacgtcacgaccgatagccggtgccctacacagggcgaagccatcttgccagaggaacaggaccagaattatgtttgtaaacacacttacgtggatcgcggttgggggaacggatgcggcctctttggcaaggggagtctggtaacctgcgctaagttccaatgtttagagctgatagagggaaaagtggtccagcacgaaaatctcaagtatacagtgattatcactgttcataccggtgaccagcaccaggtgggcaacgagacacaaggggtcaccgccgaaattactccccaggcatccacggtggaggctatccttcctgaatacggaacactgggcttggagtgctctccacgaaccggtctagactttaatgagatgatcctgctcactatgaaaaacaaggcctggatggtacatagacagtggttctttgatctgccgcttccctggaccagcggggcgacaaccgaaactcctacatggaataaaaaggagctgttggttacgttcaaaaacgcccacgcaaagaagcaagaagtggtcgtgctcggctcccaggagggagctatgcacaccgccctgactggcgctacagaaattcagacctcagggggaacaagtatatttgccggtcatttaaaatgtaggctgaagatggacaaactagagctcaagggcatgagctatgcaatgtgctctaatgccttcgtcctgaaaaaggaggtgtccgaaactcagcacgggaccatccttattaaggttgagtacaaaggagaagatgctccatgtaagatccccttctcaacggaggacggccaaggtaaagcgcataacgggcggttgataaccgcaaaccctgtggtaacaaagaaagaggaaccagtcaatattgaggccgaacccccgtttggcgagagcaacatcatcattggaatcggcgataaggctctgaagattaattggtacaaaaaggggagttctataggaaaaatgttcgaagccactgcacgtggtgcccgcagaatggctatcctcggcgacaccgcctgggattttgggtccgtgggaggcgttctgaacagccttggtaagatggtgcaccagattttcgggtcggcatatacagcgctgttttctggcgtctcctggatcatgaaaatcggaattggcgtgttgctcacttggatagggctaaattcaaagaacaccagtatgagcttctcctgcatcgtaattggaatcattacgttatacctgggcgctgtggttcaggccgacatgggttgtgtcatcaattggaaggggaaagagctaaagtgcggatctggcatatttgtgacaaacgaggtgcatacctggactgaacagtataaattccaagcagatagccctaagaggctcgccacagctatcgccggtgcatgggagaatggcgtctgtgggattcggtcaaccactcgaatggaaaacctgctttggaaacagatcgctaatgagttgaactacattctgtgggaaaataacatcaagctcaccgttgtggtgggagacataattggcgtactggagcaggggaaacgcacattaacgccccagccaatggagctgaagtatagttggaagacctggggaaaagccaagatcgtcactgcggaaattcaaaattccagctttatcatagatggccctaacacacccgagtgcccaaacgcctctagagcttggaatgtgtgggaagttgaggactacggtttcggggtgtttaccacaaacatctggcttaaattgagggaaatgtatactcagctctgtgaccaccggctgatgtcagcagccgtcaaggatgagcgcgctgtgcacgccgacatgggatactggattgagagtcagaaaaatggcagctggaagctagaaaaggcatccctgatcgaggttaaaacctgcacgtggcccaagtctcatacactctggtcgaacggtgtgctggaaagcgatatgattatccctaaatcccttgcgggcccaatatcacagcacaattacagaccggggtatcatacccaaactgccggaccctggcacttgggcaagctggagttagacttcaactactgcgaggggaccacagtagtcattactgaaaattgtggaaccaggggccctagtctccgtacaacgaccgtgtctggtaaactgatccacgagtggtgctgtcggagctgcactcttccacccctgcgatatatgggggaagatggatgttggtacggcatggagatcagacctattaacgaaaaggaggagaatatggtgaagtccttggtctcagctggtagcggcaaagttgacaactttacaatgggggtgctctgcctggccatcctattcgaagaggtaatgaggggaaagttcggcaaaaagcatatgattgcaggggtgctgtttatgttcgtcctcctgctttctggacagataacctggcgcgatatggctcggactttgatcatgattggctccaatgccagtgacagaatgggtatgggggtgacatatctggcattaatcgccacctttaaaattcagccattcctcgctctgggatttttccttaggaagctgacgagccgcgaaaacctactcctgggcgttggcttggcgatggccactaccctgcaattacccgaggatatcgaacagatggcaaatgggatagctctcggactgatggcccttaagctgatcacacagtttgagacctaccagttgtggactgccctcgtgtctctgacatgttccaacaccattttcacactaactgtcgcttggcgaaccgcaacgctgatccttgccggtatttcactcctgccggtgtgccaaagtagctcgatgcggaaaacagactggttgcctatgaccgttgcggctatgggcgtgccacccctgcctttatttatcttctccctcaaggatactctgaaacgtagatcttggccccttaatgagggggtcatggccgtaggactggtgagcatattggcatcaagtctcctgaggaacgacgttccaatggccggccctctagtggctggtgggctgcttattgcatgttatgtcatcaccggaacatccgccgatctcactgtggaaaaggcggctgacgtaacctgggaggaagaggccgaacagacgggcgtgtctcacaacctgatgatcacagtcgacgatgacggcaccatgcgcattaaagatgacgagactgagaatatattgacagttttactgaagaccgcactcctgatcgtgagcgggatttttccctactccatcccagccactcttctggtgtggcatacatggcagaaacagacccaacggtcaggagtcttgtgggatgtgccgagccctcccgaaacgcagaaggctgagctagaagagggtgtttacagaattaagcagcagggcatcttcgggaaaactcaagtaggagtgggcgtccagaaggagggtgtgtttcacaccatgtggcatgttacaagaggggccgtgctgacctataacggaaaacgactcgaaccaaattgggcaagtgtcaagaaagacctgatatcttacggcggcgggtggcgcctttccgctcagtggcaaaagggagaggaagtgcaggtaatcgccgtcgagcccggtaagaaccctaaaaatttccagacaatgccaggcattttccagactaccacgggggaaatcggagcgattgccttagattttaagcccggcacaagcggttcgcctatcataaaccgggaggggaaagtggttggactgtatggcaatggcgtggtcactaagaacgggggatacgtgtcaggtattgcacaaaccaatgctgagccggacggcccaacacccgaactcgaggaagagatgttcaaaaagagaaacttgaccatcatggatctgcaccctgggtctggaaagactaggaaatatctcccagccatcgttcgtgaagctattaagcgccggctgagaacccttatcctggcacccacaagggtggtcgccgccgagatggaggaggctttgaaaggcctacctatacgataccagacgactgcgaccaagagtgagcacacaggtaaagaaattgtggacctgatgtgccatgcaacctttactatgcggctcttatccccggtacgcgtgcccaattataacctgatcattatggatgaggcccacttcacagacccagctagcatcgccgcaagagggtacatatctaccagggttggaatgggcgaagccgctgcgatttttatgacggccactcctcccggcacagcagatgctttcccacagagcaatgcccctatccaggacgaggagcgggacatccccgaacgatcctggaactcagggaatgattggattaccgactttgcaggaaagaccgtctggttcgtgccaagtatcaaggccggtaacgatattgctaactgtcttaggaagaatggcaagaaagtgatacaactgagccgcaagacttttgacacagagtaccagaaaaccaagctcaacgattgggacttcgtcgtaacaactgatatctctgaaatgggggccaattttaaggcggacagggtgattgatccgcgtcggtgcttgaaacctgttatcctgacggacggacccgagagagtgatcctcgcaggcccaatgcccgtcaccgtggcctccgctgcccagaggcgcggtcgagttgggagaaaccctcagaaggagaatgatcaatatattttcacaggccagccactgaacaatgacgaagaccatgctcactggactgaggcaaaaatgcttctagataacataaatacccccgaaggaatcattcctgccctgttcgagccggaacgggagaagtcagctgccatcgacggcgagtacaggttgaaaggggaaagtcgcaagacatttgtggagttaatgcgtagaggagatctgccagtctggctcgcacataaagtggcgagcgaaggtattaagtataccgaccggaagtggtgcttcgatggcgagaggaacaatcagatcctggaagagaacatggacgtagagatatggactaaagaaggggagaagaagaaacttcgcccccgatggctggatgccagaacgtactccgaccctctcgctttgaaagaatttaaagatttcgccgcaggacggaagtctatcgctctggacctagtgaccgagattggcagggttccctcgcacctggcccaccgcacaagaaatgcactcgataaccttgtcatgctgcatactagcgaacacggtgggagggcctatcggcatgctgtggaggagttaccagaaaccatggagacattgctgctcctgggccttatgatcctgctcaccggaggcgcgatgttgtttctgatttcagggaaaggagtgggtaagacttccatcggcttaatatgtgtcgttgccagttctgggatgctatggatggcagacattcctctgcagtggatcgctagcgccattgtgctcgagttctttatgatggtacttctgatccccgagccagagaaacaacgtacacctcaggataatcagttggcctacgtggtcataggaatcctgacgctcgcagctattgtggccgcgaacgaaatgggcatgctggagaccactaagcgcgaccttggtatgtccaaagaaccgggggttgtgtcacccacatcttatctcgacgtcgatctgcacccagctagcgcctggaccttgtacgcagtagccaccacagtgatcactcctatgctgcgacacacgattgagaatagtaccgctaacgtttccttagcagccatcgcgaaccaagctgtggtcctaatgggcctggacaagggatggcccataagcaagatggatctcggcgtgccacttctggccttggggtgctactctcaggtcaatcctctgacactcactgcagccgtgctgcttttagttacccattatgctattatcggacccggcctgcaggccaaagcaacaagagaagctcagaagaggaccgccgcgggtatcatgaaaaacccgactgtggacgggattatgacgatcgatctcgacccagtaatatacgattcaaagttcgagaaacaattgggacaggtgatgctgctagtcctgtgtgccgttcagctccttctgatgcggacatcctgggcattttgcgaggctttgaccctggccactggccctattaccacactctgggaaggtagtcccggcaagttctggaatactaccatcgcagtgagcatggctaacatttttcgcgggtcgtatctggccggagccggcttagcgttctctatcatgaagtccgtcgggacaggaaaaagaggcacgggtagccagggggagacccttggagaaaagtggaaaaagaaactgaatcaactctcaaggaaggagtttgacctatacaaaaagagtggcataactgaagtggatcggacagaggctaaggagggtctgcgaagaggcgaaatcacccaccatgcagtatctcgcgggtccgccaaattgcagtggttcgtggagaggaacatggttattccagaaggacgggtgatcgacctgggctgtgggcgtggaggctggagctattactgcgctggtctcaagaaagtcactgaggtgagagggtatacaaagggaggccccggccacgaagaacctgtcccgatgtcaacctacgggtggaatattgtgaaacttatgagtggaaaggatgttttctacctgcccccagagaagtgtgacacgttgctgtgcgatatcggtgaaagctccccttctcccaccgtagaggaaagcaggacaattcgcgtgctcaaaatggtcgagccttggttaaagaacaatcagttttgtatcaaagtgctgaacccatatatgcccactgttatagagcatcttgaacggctgcagcgaaagcacggcgggatgctagtgagaaatcctctctccaggaactcaacccacgagatgtactggatttctaatggaacaggcaacatcgtcagttcggtgaatatggtaagccgcctgttgctgaaccggttcactatgacctatagacgtccaacaatcgaaaaagacgtggacctcggtgccgggaccaggcatgttaacgcagagcccgaaactccgaatatggatgtcattggagagcggatacgccgaatcaaggaggaacactcctctacgtggcattacgacgatgagaacccttataagacatgggcctaccacggctcatatgaagtgaaagctaccggcagcgcgtccagtatgattaatggggtggtcaaacttctgactaaaccatgggacgttgtgcccaccgtaacacaaatggccatgacggataccactccttttggacagcagagagtgttcaaggagaaagtcgacacaaggaccccaaagcccatgccgggtactcggaaggcaatggaaatcacagctggctggttatggcgcaccctggggagaaacaaaaggcctcgattgtgcacacgggaggagtttactaagaaagtgcgtaccaatgccgcaatgggagccgttttcacggaagagaaccaatgggattctgctagagccgcggtggaagacgaggaattttggaagctcgtcgatcgcgagagggagctgcacaaacagggcaagtgtggtagctgcgtgtacaatatgatggggaaacgggaaaagaagctaggagagttcggcaaagcaaagggctcaagagccatttggtacatgtggcttggggctcgctatctggaatttgaggccctcggattcctgaacgaggaccattggttttccagggaaaatagttacagcggtgtagagggcgaagggttgcacaaactgggatatatcctccgagatatatctaagatccccggcggtgcaatgtacgctgacgacaccgccgggtgggatacacggattactgaggacgatcttcataacgaagagaaaatcacccagcagatggacccagagcacagacaactggctaatgccattttcaagttaacatatcagaacaaggttgtgaaagtccagaggcctactcccaagggaaccgtgatggatatcatatcccgcaaagaccagcgtggctcaggccaagtggggacgtacggactgaatacatttaccaacatggaagtccagttgattcggcagatggagggtgaaggcgttctcagcaagactgatctggagaatccacatctacttgagaagaagatcacacagtggctggagaccaagggggtggagagactcaaaaggatggcaatctcgggagacgattgcgtagtgaagcccattgacgatcgcttcgcgaacgccctgttggctttaaacgacatgggcaaagtccgaaaggatatacctcaatggcagccatctaaaggttggcacgactggcaacaggtgccgttctgtagtcaccattttcacgaactgatcatgaaggacgggcggaagctcgttgtgccctgcagacctcaagatgagcttattggaagggcccgcatctcccagggcgcaggctggagcctgaaagaaactgcttgtctagggaaggcctatgcacagatgtgggccctgatgtacttccatagacgggacctcaggttggcgtcaaatgctatttgctccgccgtcccagtgcactgggtacccacctctcgtacaacgtggagcatccacgcacatcaccaatggatgaccactgaggatatgctgacagtttggaaccgagtgtggatagaagacaatccttggatggaggataaaaccccagtcactacatgggaggacgtgccctaccttggaaagcgcgaagatcagtggtgtggtagtctgatcggcctcacctccagagccacgtgggctcagaacattttaacagccatccagcaagttcggagcctgattgggaatgaggaatttttggactatatgccttctatgaaaaggttccgcaaggaggaggaatcagagggagcaatctggtga

SEQ ID NO: 15661 - RNA, 9873 nt, synthetic construct
  misc_feature 1..9873: note = derived and/or modified CDS sequence (opt3) from DENV-3__AY858047__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagagcacaaacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctagactttaatgagatgatcctgctcactatgaaaaacaaggcgtggatggtacatagacagtggttctttgatctgccgcttccctggaccagcggggccacaaccgaaactcctacatggaataaaaaggagctgttggttacgttcaaaaacgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggacaaactagagctcaagggcatgagctatgccatgtgctctaatgctttcgtcctgaaaaaggaggtgtccgaaactcagcacgggaccatacttatcaaggttgagtacaaaggagaagatgcgccatgtaagattcccttctcaacggaggacggccaaggtaaagcacataacgggcggttgatcaccgccaaccctgtggtaacaaagaaagaggaaccagtcaatatagaggctgaacccccgtttggcgagagcaacattatcatcggaattggcgataaggccctgaagatcaattggtacaaaaaggggagttctattggaaaaatgttcgaagcaactgcccgtggtgctcgcagaatggccatactcggcgacaccgcatgggattttgggtccgtgggaggcgttctgaacagccttggtaagatggtgcaccagatcttcgggtcggcgtatacagctctgttttctggcgtctcctggattatgaaaatcggaatcggcgtgttgctcacttggattgggctgaattcaaagaacaccagtatgagcttctcctgcatagtaatcggaattatcacgttatacctgggcgccgtggttcaggcagacatgggttgtgtcattaattggaaggggaaagagctaaagtgcggatctggcatctttgtgacaaacgaggtgcatacctggactgaacagtataaattccaagccgatagccctaagaggctcgctacagccatagcaggtgcttgggagaatggcgtctgtgggatccggtcaaccactcgaatggaaaacctgctttggaaacagattgccaatgagttgaactacatcctgtgggaaaataacattaagctcaccgttgtggtgggagacatcataggcattctggagcaggggaaacgcacattaacgccccagccaatggagctgaagtatagttggaagacctggggaaaagcgaagatcgtaactgccgaaattcaaaattccagctttatcatagatggccctaacacacccgagtgcccaaacgcttctagagcatggaatgtctgggaagtggaggactacggtttcggggtttttaccacaaacatctggcttaaattgagggaaatgtattcacagctctgtgaccaccggctgatgagtgccgctgtgaaggatgagcgcgccgtccacgcagacatgggatactggattgagagccagaaaaatggctcctggaagctagaaaaggcgtctctgatcgaggtgaaaacttgcacctggcccaagtcgcatacgctctggagcaacggtgttctggaatccgatatgattatccctaaatcacttgccggcccaataagtcagcacaattacagaccggggtatcatacacaaaccgctggaccctggcacttgggcaagctggagttagacttcaactactgcgaggggactaccgtggtaattacagaaaattgtggaactaggggcccttctctccgtaccacaacggtcagcggtaaactgatccacgagtggtgctgtcggtcctgcacccttccacccctgcgatatatgggggaagatggatgttggtacggcatggagatcagacctattaacgaaaaggaggagaatatggtgaagtcattggtgagcgccggttctggcaaagtcgacaactttactatgggggttctctgcctggcaatcctattcgaagaggtgatgaggggaaagttcggcaaaaagcatatgattgctggggtactgtttacattcgtgctcctgctttccggacagataacctggcgcgatatggcccggactttgatcatgattggcagtaatgcaagcgacagaatgggtatgggggtcacatatctggccttaatcgctacctttaaaattcagccattcctcgcgctgggatttttccttaggaagctgacgtctcgcgaaaacctactcctgggcgtgggcttggccatggcaactaccctgcaattacccgaggatatcgaacagatggctaatgggatagccctcggactgatggcccttaagctgatcacacagtttgagacctaccagttgtggactgctctcgtttccctgatgtgttcaaacacaattttcaccctaacagtggcatggcgaactgccaccctgatccttgcgggtattagtctcctgccgttgtgccaaagctcgtccatgcggaaaacggactggctgcctatgacagtcgctgccatgggcgtgccacccttacctctctttatcttctctctgaaggatacccttaaacgtagaagctggcccctgaatgagggggttatggcagtgggattggtctcaatactcgccagttccctgctaaggaacgacgtaccaatggctggccctctggtggcaggtgggcttctcattgcctgttatgttatcactggaacctctgcggatctgacagtggaaaaggctgccgacgtcacttgggaggaagaggcagaacagaccggcgtgagccacaacttgatgatcacggtagacgatgacggcacaatgcgcattaaagatgacgagaccgagaatatattaactgtgctgctcaagacagccctgcttatcgtctccgggatttttccctactcaatcccagctaccctgttggtttggcatacttggcagaaacggacacagagaagcggagtgctatgggatgtgccgagtcctcccgaaacccaaaaggccgagctggaagagggtgtctacaggattaagcagcagggcatcctcgggaaaacgcaggtgggagttggcgtacaaaaggagggtgtgttccacactatgtggcatgtcacccgaggggcagtgctgacatataacggaaaacgccttgaaccaaattgggcttctgttaagaaagacttaatatcctacggcggcgggtggcggctgagcgcccagtggcagaagggagaggaagtgcaagtcatcgcggtggagcccggtaagaaccctaaaaattttcagaccatgccaggcattttccagacaactaccggggaaatcggagccattgcactcgatttcaagcccggcacgtcgggttcacctatcataaacagagaggggaaagtagtcggattgtatggcaatggcgtggttacaaagaacgggggatacgtgtctggtattgctcagactaatgccgagccggacggcccaacccccgaactggaggaagagatgtttaaaaagaggaacctcacaatcatggatctgcaccctgggagtggaaagacccgtaaatatcttccagctatcgtccgcgaagcaattaagcggagactgaggactttgatcctagcccccacccgagtggttgccgctgagatggaggaagcgctgaaaggcctccctatacggtaccaaacaacggcaactaagtccgagcacaccggtaaagaaattgtggacttaatgtgccatgccacattcaccatgcgcctgcttagcccggtcagagtgcccaattataacctgatcattatggatgaggctcactttactgacccagcctctatcgcagccagggggtacataagcacacgggtaggaatgggcgaagctgcggccattttcatgaccgcaacgcctcccggcactgctgatgcctttccacagtccaatgcacctatccaggacgaggagcgagacatccccgaaagatcatggaacagtgggaatgattggattacagacttcgccggaaagaccgtgtggtttgttccaagcatcaaggctggtaacgatattgccaactgtctccgcaaaaatggcaagaaagtcatacagttgtctaggaagaccttcgacactgagtaccaaaaaacaaagctgaacgattgggactttgtggtgaccacagatatctccgaaatgggggcgaatttcaaggcagaccgtgtcattgatccgcggagatgcctcaaacctgtaatcctgactgacggacccgagagggtgatccttgccggcccaatgcccgttacggtggcttcagccgctcagcgccgaggtagagtcgggcggaaccctcagaaggagaatgatcagtatatttttaccggccaaccactaaacaatgacgaagaccatgcacactggacagaggccaaaatgctgttggataacataaatactcccgaaggaatcattcctgctttattcgagccggaaagggagaagagtgccgcaatcgacggcgagtaccgcctgaaaggggaaagccgtaagaccttcgtggagctcatgagacggggagatctgccagtttggcttgcgcataaagtggcctccgaaggtattaagtatacagacaggaagtggtgctttgatggcgagcgcaacaatcagatcctggaagagaacatggacgtcgagatatggaccaaagaaggggagaagaaaaagctccgacccagatggttggatgctcggacttactctgaccctctggccctaaaagaattcaaggattttgcagctggaaggaagtcgatcgccctggacctcgtgacggagattggccgcgtacccagccaccttgcacacagaaccaggaatgccctggataacttagtgatgttgcatacatcagaacacggtgggcgggcttatcgtcatgcggttgaggagctgccagaaactatggagaccctcctgcttctgggcctcatgatcttgctgacaggaggcgtcatgttattcctaatttccgggaaaggagtgggtaagaccagtatcggcctgatatgtgtggtcgcctctagcgggatgctctggatggcagacattcctcttcagtggatcgcttccgccattgttctggaatttttcatgatggtgttgctgatccccgagccagagaaacagcgcactcctcaagataatcagctcgcctacgtagtgataggaatcctgacacttgcagctattgtcgccgcgaacgaaatgggcctcctggagacgaccaagcgagacttgggtatgtcaaaagaaccgggggtggcttctcccactagctatctggacgttgatttacacccagccagtgcatggacactatacgccgtggctaccaccgtcatcacacctatgctgagacacactattgagaattccacggcaaacgtaagcctcgccgcgatcgctaaccaggccgtggttcttatgggcctggacaagggatggcccatatctaagatggatttgggcgtgccactgctcgcactggggtgctactcacaagtcaatcctcttaccttaacagccgctgtgctgctcttggtcactcattatgccattatcggacccggcctgcaggcaaaagctaccagggaagcccagaagcggacagcggccggtatcatgaaaaacccgaccgtggacgggattatgactatcgatctagacccagttatatacgattccaagtttgagaaacagctgggacaagtgatgctccttgtactgtgtgcagtgcagttgctgctcatgcgcacgagttgggctttctgcgaggccctgacattagcaaccggccctattactaccctttgggaaggtagccccggcaagttttggaatacaactatcgctgtctcgatggccaacattttcagagggtcttatctggccggagcgggcctcgctttttccatcatgaagagcgttgggaccggaaaaaggggcacaggttcacagggggagacgctaggagaaaagtggaaaaagaaactgaatcagttgagtcggaaggagttcgacctgtacaaaaagtctggcataaccgaagtggatcgaactgaggcaaaggagggtctcaaaagaggcgaaatcacacaccatgccgtctcccgcgggagcgctaagcttcaatggtttgtggagaggaacatggtaattccagaaggacgggtgatcgacctgggctgtgggcgtggaggctggtcatattactgcgccggtttgaaaaaggttaccgaggtgagagggtatactaaaggaggccccggccacgaagagcctgtcccgatgagtacatacgggtggaatattgtgaagctgatgagcggaaaggatgtcttctacctccccccagagaaatgtgacaccttactgtgcgatatcggtgaatcctctcctagccccacggtggaggaatccaggaccattcgcgttcttaagatggtagagccttggctgaaaaacaatcagttctgtatcaaggtgctaaacccatatatgcccgcagtcatagagcatctcgaacggctgcagcgaaaacacggcgggatgttggtgagaaatcctctgtcaaggaactctacacacgagatgtactggattagtaatggaactggcaacatcgtttcgagcgtgaatatggtctcccgcctccttctgaaccggtttaccatgacatatagacgtccaactatcgaaaaggacgtggacttaggtgccgggaccaggcatgtaaacgctgagcccgaaacaccgaatatggatgtgattggagagcggatacgccgaatcaaggaggaacactcttcaacctggcattacgacgatgagaacccttataaaacttgggcgtaccacggcagctatgaagttaaggccacgggctccgcaagttctatgattaatggggtcgtgaaactgttgacaaagccatgggacgtggtccccaccgttactcagatggctatgaccgatacaacgcctttcggacaacagagagtgtttaaagagaaggtagacaccaggactccaaagcccatgccgggtacacggaaagtgatggaaatcaccgccgagtggctctggcgcactctgggcagaaacaagaggcctcgactatgcacacgggaggaattcaccaaaaaggtccgtacaaatgcagccatgggggctgtgtttactgaggaaaaccagtgggatagcgccaaagcggcagttgaggacgaagagttctggaagcttgtggatagagagcgcgaactgcacaaactcggaaagtgtggctcatgcgtctacaatatgatgggtaagagggagaaaaagctgggggaatttggaaaagccaagggctcccgggctatttggtacatgtggttgggcgccagatatctggagttcgaggcactcgggtttcttaacgaagaccattggttcagtcgcgagaatagctactctggagtggaaggtgagggcctgcacaaattagggtatatcctgagggatatatccaagatccccggaggcgctatgtacgccgacgacaccgctggttgggatacgcgaattaccgaagacgatttgcataacgaggagaagatcacacaacagatggacccagaacaccggcagctcgccaatgcaatttttaaactgacttatcagaacaaggtagttaaagtgcaaagacctacccccaaggggacagtcatggatatcatatcaaggaaagaccagcgcggaagcggccaggtgggcacttacgggctaaataccttcacgaacatggaggcgcagcttattcgtcaaatggaaggagagggtgtgctgtcgaagacagatctcgaaaatccacatctgttggagaagaaaatcacccagtggttagagactaagggcgtcgaacggctgaaaagaatggccatctctggggacgattgcgttgtgaagcccattgacgataggtttgctaacgccctccttgcactgaacgacatgggaaaagtacgcaaggatatacctcagtggcagccaagtaagggctggcacgactggcaacaggtgccgttctgttcccaccatttccacgagctaatcatgaaagacggtcgaaagctggtcgtgccctgccggcctcaggatgaactcattgggagagctaggatcagccagggagccggctggtcattgaaagagacagcatgtctgggcaaggcctatgcgcaaatgtgggctcttatgtactttcatcgcagagacctgcggctcgcctccaatgcaatttgctctgccgttccagtgcactgggtccccaccagcaggactacctggagtatccacgctcatcaccagtggatgacaacggaagatatgttaatagtgtggaaccgtgtatggatcgaggacaatccttggatggaggataaaaccccagttactacatgggaagacgtgccctacctggggaagcgagaggatcagtggtgtggatccttgattggtctgaccagccgcgccacttgggcacaaaacatcctcacagctattcagcaggtcagatctcttatcggcaatgaagagttcctggactatatgccttcaatgaagcggtttaggaaagaggaagagagtgaaggggccatttggtga

SEQ ID NO: 15662 - RNA, 9873 nt, synthetic construct
  misc_feature 1..9873: note = derived and/or modified CDS sequence (opt3) from DENV-3__HQ332170__SS-prME
  source 1..9873: mol_type = other RNA
accagcctgtgcctcatgatgatccttcccgccgctctggcattccacttgacctccagggacggcgaacctaggatgattgtggggaagaacgaacggggaaaatctttactgtttaagactgcctcaggtataaatatgtgtacgctaatcgcgatggatctcggcgaaatgtgcgacgataccgtaacatacaaatgtccacatattactgaagttgaaccggaagacatcgattgctggtgtaacctgaccagtacatgggtgacctatgggacttgcaatcaggctggagaacaccgccgagacaagcgtagcgtagcccttgcaccccatgtgggcatgggtctggatacaagaacccagacgtggatgtccgccgagggggcttggaggcaggtagaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgacagaggccatcctcccagaatatggaacccttggcctggagtgctctccgcgaactggtttggacttcaatgagatgatcctactgaccatgaaaaacaaggcgtggatggtgcatagacagtggtttttcgatctccccctgccttggacaagcggggccaccactgaaacaccaacgtggaataggaaagagcttctggtaacctttaagaacgcacacgctaaaaagcaagaagttgtggtcttgggctcccaggagggagccatgcacactgctctcacaggcgccaccgaaattcaaaattcagggggaacaagtatattcgcaggtcatctgaagtgtcggttaaaaatggacaagctggagctaaaaggcatgagctacgccatgtgcactaacacctttgtgctcaagaaagaggtctctgaaacgcagcacgggaccatcctgattaaggtggattacaagggagaggacgttccctgtaaaatccctttctccacagaagatggccaaggtaaggctcataacgggcgtcttataactgcgaatccagtggtaaccaaaaaggaggagcccgtcaacattgaagcagagccgcctttcggcgaatcaaatatcgtgatcggaattggcgacaacgccttgaaaatcaattggtataagaaggggagcagtattggaaaaatgtttgaggctacagcccgcggtgcaagaaggatggccatactgggcgatactgcttgggacttcgggtctgttggaggcgtgctcaactccctgggtaagatggtccaccagatctttgggagcgcctacaccgcacttttctcgggcgtgtcttgggtaatgaaaattggaatcggcgtgctgttgacgtggatcgggctcaattccaagaacacatcaatgagttttagctgcattgcgataggaatcattaccctgtatttaggcgctgttgtccaggccgatactggttgtgtgatcaattggaaagggaaggaactgaagtgcggatccggcattttcgtgacaaacgaggtccatacctggactgagcagtacaaatttcaagcagactctcccaagcggctagccaccgctatcgccggtgcatgggaaaatggcgtttgtgggatacgaagcacaacgcgcatggagaacctcctgtggaaacagatcgctaatgaacttaactatattttgtgggagaataacatcaagctgaccgtggtggtaggagatattatcggcgtcctcgaacaggggaaaagaactctgacaccacagcctatggagttaaagtactcatggaaaacctggggaaaggccaagatagtgacagcggagactcaaaacagttccttcattatcgacggccccaataccccagaatgccccagcgcctctagggcttggaacgtttgggaggtggaagactatggttttggggtcttcacgacaaatatttggctgaaacttcgggaggtgtacacccagcagtgtgatcaccgcttgatgtcagcagccgttaaggacgaaagagctgtgcacgccgatatgggatactggatcgagagtcagaaaaacggcagctggaagctcgagaaagcatccctgatagaagtaaagacttgcacctggcctaagtctcatacactatggtcgaatggtgtcctggagagcgacatgatcattccaaaatccctcgcgggcccgatctcacaacacaactataggcccgggtaccatactcagaccgccggaccttggcacctgggcaaacttgaattggattttaattattgcgaggggacaacggtggtgattaccgagaactgtggaactcgtggcccaagtctgcggacaaccactgtctctggtaaattaatccacgaatggtgctgtcgaagctgcacactcccacctctgagatacatgggggaggacggatgttggtatggcatggaaataaggccaatttccgagaaggaagagaatatggttaaatcacttgtgagcgctggttctggcgaggtagataacttcaccatgggggtgctgtgcttggccatcctctttgaagaggtcatgcgcggaaagttcggcaagaaacatatgatcgcaggggtgttctttacgttcgttctgctactgtccggacagattacttggcgggacatggctcacaccctcatcatgattggcagtaatgccagcgatagaatgggtatgggggtgacatacctggcacttatagccacctttaagatccaacccttcttggctctgggatttttcttaaggaaactcacttctcgcgaaaacctgcttctgggcgtcggcctagcgatggccacaaccctccagctgccggaggacattgaacagatggcaaatgggatcgctttgggactgatggccttaaagctcattacacagtttgagacttatcaactgtggaccgcccttatctccctgacgtgttcaaacacaatattcaccttgactgtggcttggcgaaccgcaacactcatcctggccggtgttagtctactgcctgtgtgccagagctcgtccatgcggaaaactgattggcttccaatgaccgtcgcggctatgggcgtaccccctctccccctgtttattttctctttgaaggacacgctgaagcgtagaagctggccattaaatgagggggtgatggccgttggactcgtgtcaatcctggcaagttcccttctgaggaacgatgtccctatggccggccccttggtggctggtgggctcctgattgcatgttacgtaatcacaggaacctctgccgacctaactgtggaaaaagcggctgacgtcacatgggaggaagaggccgaacagaccggcgttagccataacctgatgataactgtggatgacgatggcacaatgcgcattaaggacgatgagaccgagaatatccttacggtgctcctgaaaactgcattgttaatcgtctccgggatttttccatactcaataccggccaccctgctcgtgtggcacacatggcagaagcaaacccagcggagcggagttctgtgggacgtacctagtcccccagaaacacagaaagctgagcttgaagagggtgtgtatagaatcaagcagcaaggcattttcgggaaaactcaggtcggagtgggcgttcagaaggagggtgtgtttcataccatgtggcacgtcacgagaggggccgtgctgacatacaacggaaagcgattggaacccaattgggcatctgtcaagaaggatctaatctcctatggcggcgggtggcgcctgagcgctcaatggcagaaaggagaggaagtccaggtgattgccgttgagcctggtaagaaccccaagaatttccagactatgcccggcaccttccaaacaaccactggggaaatcggagcgatagccctcgactttaagcctggcacctcgggttcaccgatcattaaccgggaggggaaggtggtcggactgtacggcaatggcgtggttaccaagaacgggggatatgtgtctggtatcgcacagacgaatgctgagccagatggccccactcctgaacttgaggaagagatgttcaagaaaagaaacttaaccattatggacctgcacccagggagtggaaagacaaggaaatacctccccgccatcgtccgtgaagctataaagcgccggttgagaaccctgattctcgcacctactagggtggtagccgccgagatggaggaagctctgaagggccttccgatccgatatcagacaaccgcgacgaaatccgagcatactggtcgggaaatcgtggatctgatgtgccacgcaacatttaccatgcgcttgctaagccccgttagagtcccaaattacaacctgattatcatggacgaggcccatttcaccgatcctgcttctatagccgcaagggggtacattagcactcgggtgggaatgggcgaagccgctgcgatctttatgacagccacacccccaggcacagcagacgctttccctcagtccaatgcccccattcaagacgaggagcgagatatcccagaaagatcatggaacagtgggaatgagtggataactgactttgcaggaaagacggtgtggttcgtcccgagcattaaagccggtaacgatatcgctaactgtctccgcaagaatggcaaaaaggtaatccagttatctaggaagacctttgacacagaatatcagaaaactaagctgaacgattgggacttcgtggttaccacagatatttccgagatgggggccaattttaaagcggaccgtgtgatcgatcctcggagatgccttaagcccgtcattctgaccgacggaccagagagggtgatactcgcaggccccatgcctgttactgccgcttcagccgctcagcgccgaggtagagtggggcggaacccacaaaaagaaaatgatcagtacatcttcacgggccagcccttgaacaatgacgaggaccacgcacattggaccgaagccaagatgctgctcgataacattaatacacctgagggaatcatcccggctctgttcgaaccagagagggagaagagtgccgcaattgacggcgaatatcgccttaaaggggagagccgtaagacttttgtcgaactaatgagacggggagatctgcccgtgtggttggcgcacaaagtagcctccgagggtataaagtacaccgacaggaaatggtgcttcgatggccagcgcaacaatcaaatcttagaagagaacatggacgtggagatttggacaaaggaaggggagaaaaagaagctgcgacctagatggctcgatgctcggacctattctgaccccctggcccttaaagaatttaaggatttcgcagctggaaggaaatcgatcgccctggacctcgttactgagattggccgcgtcccaagccacttggcacatagaacaaggaatgccctggataacctagtgatgctgcacacgtcagaacatggtgggaaggcttaccggcacgcggtggaggagctccctgaaaccatggagactcttctgttattgggcctgatgatcctcctgacaggaggcgccatgctttttctgatatccgggaaaggaatcggtaagaccagtattggcctcatctgtgtcattgcatctagcgggatgttgtggatggctgaaatccccctgcagtggatagcctccgccattgttttagagttctttatgatggtgctactgatcccagagcctgaaaagcagcgtaccccgcaagacaatcagctcgcatatgtagtgattggaatccttacactggctgccataatcgcggctaacgagatgggcttgctggaaactacgaaacgcgatctcggtatgtcaaaggagcccggggtcgtgtctccaaccagctacctggacgttgaccttcaccctgccagtgcatggacactctacgccgtggctactaccgtcattacacccatgctgcgacataccatcgaaaattccactgcaaacgtcagcttggccgcgattgctaaccaggccgtggttctgatgggcttagataaaggatggccaatctctaagatggacctaggcgtgcctctgctcgcacttgggtgctattcacaggtcaatcccctgacgttgacagccgctgtgctgctcctgataacccactacgccattatcggaccgggccttcaagcaaaagctactagagaggcccagaagaggaccgcggccggtatcatgaagaacccaacagtcgatgggattatgactatcgacttagatcctgtgatatatgactccaaattcgagaagcagctgggacaggttatgctcttggtgctgtgtgcagtacaactactgctcatgcggaccagttgggctctttgcgaagccctgacattggcaacgggccccattaccactctgtgggagggtagcccaggcaaattttggaatacaaccatcgctgtgtcgatggccaacattttccgcgggtcttacctcgccggagcgggcctggctttttccatcatgaaaagcgtcgggactggaaaaagaggcacaggttcacagggggaaaccttaggagagaagtggaagaagaaacttaatcagctgagtaggaaagagttcgatctctataagaaatctggcataacggaggttgaccggaccgaggcaaaagaaggtctaaaacgaggcgagatcacacatcacgccgtgtccagagggagcgctaagctgcagtggtttgtcgaacgctcaatggtgattcccgagggaagggtaatcgatttgggctgtgggcggggaggctggagttactattgcgccggtctgaagaaagtgactgaagttcgtgggtacaccaagggaggccctggccatgaggagccggtgcccatgagcacatacgggtggaacattgtcaaactcatgtccggaaaggacgtgttctatcttccacctgaaaaatgtgatactctgttgtgcgacatcggtgagtctagcccctcccctaccgtcgaagagtcaagaacaattagggtgctgaagatggttgagccatggctcaagaataaccaattctgtatcaaagtattaaatccctacatgcctaccgtgatagaacacctggagcgccttcagcggaagcacggcgggatgctggtccgaaacccactatctagaaatagtactcatgaaatgtattggatttcgaacggaacgggcaatatcgtggcaagcgttaacatggtgtccaggctcctgttgaatcgctttacaatgacccaccggagacccactatcgagaaagatgtcgacctgggtgccgggacccgtcatgtgaacgctgaaccggagacacctaacatggacgtaattggagagaggataaagcggatcaaagaagaacacaattctacgtggcactacgatgacgaaaacccatataagacctgggcgtaccatggctcatatgaggtgaaggccactggcagcgcatccagtatgattaatggggttgtcaaactccttacaaagccctgggatgtggtgcctatggtcacccagatggctatgactgacacaaccccattcggacaacagcgcgtttttaaagaaaaggtggatacacgaactcccagatctatgccgggtaccaggcgggtaatgggcatcacggccgagtggctgtggcgcaccttagggagaaacaaaaagcctaggctgtgcacacgagaggagttcactaagaaagtgcggaccaatgcagccatgggagctgtctttacagaggaaaaccagtgggacagcgccaaggcggcagtggaggatgaagacttctggaaattggttgatcgtgagagagagctccacaagctgggcaaatgtggttcatgcgtgtacaatatgatggggaagcgcgagaaaaagctaggagagtttggcaaggccaaaggctccagggctatttggtacatgtggcttggggcccggtatctggagttcgaggcactcggatttctgaacgaggaccattggttcagtagagaaaatagctactctggtgtcgagggcgaagggttgcacaagctgggatatatcctccgcgatatatccaaaatccccggcggtgctatgtacgccgacgacactgctgggtgggataccaggattacggaggacgatcttcataacgaagagaagatcacacagcaaatggacccagagcacaaacagctggccaatgcaatttttaagttaacctatcagaacaaggtggtaaaagttcagcgacctactcccacaggaaccgtgatggatatcatatcacggaaggaccaaagaggcagcggccaggtcgggacttacggactgaataccttcacaaacatggaagcgcagttgattaggcagatggagggtgaaggcgtgctctcgaaagccgatctggagaatccacacctacccgaaaagaaaatcacgcaatggcttgagaccaagggggtggagcgcctgaagcgtatggctatctctggagacgattgcgtcgttaaacctattgacgatcggtttgccaacgcactcctggctttgaacgacatgggcaaggtgagaaaagatataccacagtggcagccgagtaagggttggcatgactggcagcaagtacccttctgttcccaccatttccacgaattaatcatgaaagacgggaggaagctggtggtcccttgccgcccacaggatgagctcattggacgagcccggatcagccagggcgcaggctggtcacttagagaaactgcctgtctggggaaggcgtatgctcaaatgtggtccctaatgtactttcacaggcgcgacctgagactcgcctctaatgcaatttgcagcgccgtgcccgttcattgggtgcctacaagtcggaccacttggtccatccacgctcatcaccagtggatgacaaccgaggatatgttgacggtctggaacagggtgtggatagaagacaatccatggatggaggataaaacacccgtaaccacttgggagaacgttccttacctgggaaagcgtgaagaccagtggtgtggtagccttatcggcctgacctctcgagccacatgggcacagaatattccgactgctatccaacaggtgcgctcactcattgggaacgaggagttcttagattatatgccaagtatgaaaagatttcggaaggaggaggaatccgagggagccatctggtga

SEQ ID NO: 15663 - RNA, 9873 nt, synthetic construct
  misc_feature 1..9873: note = derived and/or modified CDS sequence (opt3) from DENV-3__AY858038__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagaacgcaaacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagtggtccagcacgaaaatctgaagtatactgtgataattaccgttcatacaggtgaccagcaccaggtgggcaacgagacccaaggggtcactgccgaaatcacgccccaggcatctacagtggaggctattctccctgaatacggaacccttggcctggagtgcagcccacgaactggtttggactttaatgagatgatcctactgaccatgaaaaacaaggcctggatggtacatagacagtggttctttgatctcccgctgccctggacatccggggcgaccactgaaacacctacgtggaataaaaaggagcttctggttaccttcaaaaacgcccacgcaaagaagcaagaagtggtcgtgttgggctcacaggagggagctatgcacactgccctcacaggcgctaccgaaatccagacaagtgggggaactagcatttttgccggtcatctgaaatgtaggttaaagatggacaaactggagctaaagggcatgtcttatgcaatgtgcctcaatgccttcgtcctgaaaaaggaggtgtccgaaacccagcacgggacgatacttatcaaggttgagtacaaaggagaagatgctccatgtaagattcccttctcaaccgaggacggccaaggtaaagcgcataacgggcggttgatcacagcaaaccctgtggtaactaagaaagaggaaccagtcaatatagaggccgaacccccgtttggcgagagcaacattgtgatcggaatcggcgataaggctctgaagattaattggtacaaaaaggggagttctatcggaaaaatgttcgaagccaccgcacgtggtgcccgcagaatggctattctcggcgacacagcctgggattttgggtccgttggaggcgtgctgaacagccttggtaagatggtccaccagatattcgggtcggcatatactgcgctgttttctggcgtgtcctggatcatgaaaattggaatcggcgtattgctcacctggatcgggctgaattcaaagaacacgagtatgagcttctcctgcattgctataggaatcattacattatacctgggcgccgtggttcaggcagacatgggttgtgtcatcaattggaaggggaaagagctaaagtgcggatctggcatttttgtgaccaacgaggtgcatacttggacagaacagtataaattccaagccgatagccctaagaggctcgctaccgccatcgcaggtgcttgggagaatggcgtctgtgggatacggtcaactacccgaatggaaaacctgctttggaaacagatcgccaatgagttgaactacattctgtgggaaaataacatccgcctcacagttgtggtgggagacacgattggcgtactgcagcaggggaagagaaccttacccccacaacctatggagctgaaatatagttggaagacttggggaaaggcgaaaatcgtcacagccaagacccagaattccagctttataattgatggccccaacacaccagagtggccctctgcttcaagggcatggaacgtgtgggaagttgaggactacggtttcggggtgtttactaccaatatctggcttaaattgcgggaaatgtatacgcagctctgcgaccaccgcctgatgagtgccgctgtcaaggatgagagagccgtgcacgcagacatgggatactggattgaaagccagaaaaacggctcctggaagctagagaaggcgtctctgatcgaggttaaaacatgtacctggcctaagtcgcatactctctggagcaatggtgtgctggaatccgatatgataatcccaaaatcacttgccggcccgattagtcaacacaactacaggcccgggtatcatacccagacagctggaccttggcacttgggcaagctggagttagacttcaattactgcgaagggactaccgtagtcatcacagagaactgcggaacgcgtggcccatctctccggaccactacagtgagcggtaaactgattcacgagtggtgttgccgatcctgtacccttccccctctgagatatatgggggaagatggatgctggtacggcatggagatcaggccaataaatgaaaaggaggaaaacatggtgaagtcattggtcagcgccggttctggcaaagttgacaattttactatgggggtgctctgtctggcaattctattcgaggaggtaatgcgcggaaagttcggcaaaaagcatatgatcgctggggtgctgtttacattcgtcctcctgctttccggacagatcacctggcgggatatggccagaacgttgattatgatcggcagtaacgcaagcgacaggatgggtatgggggtgacttatctggccttaattgctacctttaaaatacaacccttcctcgcgctgggatttttccttcgcaagctgacatctcgagaaaatctactcctgggcgttggcttggccatggcaaccactctgcagttaccggaggatatcgaacagatggctaacgggattgccctcggactgatggcccttaagctggtgacacagtttgagacctaccaattgtggacagctctcgtctccctgatgtgctcaaatactatcttcaccctaacggtggcatggcggacagccaccctgattcttgcgggtatcagtctcctgcctgtttgtcagagctcgtccatgcgtaaaactgactggttgccaatgaccgtggctgccatgggcgtcccccctctgcccttatttatattctctctcaaggatacactgaaaagaaggagctggccacttaacgaaggggtaatggcagtgggactggtttcaatcttggccagttccctcctgcgcaatgacgtgcctatggctggccccctagtcgcaggtgggctgcttattgcctgctatgtgatcactggaacctctgcggatctcacggtagagaaggctgccgacgtgatttgggaggaagaggcagaacagacaggcgtcagccacaacctgatgatcaccgttgacgatgacggcactatgcggataaaagatgacgagacagaaaacattttgaccgtgttactgaagactgccctcctgatcgtgtccgggatctttccatactcaattccggctacacttctggtctggcatacctggcagaaacaaacgcagagaagcggagtgttgtgggatgttcctagtcccccagagactcagaaggccgagctagaagagggtgtatacaggataaagcagcaaggcatcttcgggaaaacccaggtgggagtcggcgtgcagaaggaaggtgtttttcacacaatgtggcatgtgacccgaggggcagtcctgacacacaatggaaaacgcctcgagcccaactgggcttctgtgaagaaagacctgatttcctatggcggcgggtggcggcttagcgcccaatggcagaagggagaggaagtacaggtcatcgcggtggagcctggtaagaatccaaaaaacttccagactatgcccggcattttccaaaccacgacaggggaaatcggagccatagcattagattttaagcctggcacttcgggttcaccgatcattaatagagaggggaaagttgtgggactgtacggcaacggcgtcgtgaccaagaatgggggatatgtttctggtatcgctcagacaaacgccgaaccagacggccccacccctgagctcgaggaagagatgttcaaaaagaggaatttgactattatggatctgcacccagggagtggaaagacccgtaaatacctccccgctatcatacgcgaagcaattaagcggagactgaggacacttatcctggcccctacgcgagtggtcgccgctgagatggaagaggcgttgaaaggcctaccgatccggtatcagactaccgcaacaaagtccgagcataccggtaaagaaattgtggacctgatgtgtcacgccacttttacaatgcgcctcttaagccccgtaagagtgccaaactacaatctgatcataatggatgaggctcatttcaccgaccctgcctctattgcagccagggggtatatcagcacgcgggttggaatgggcgaagctgcggccatttttatgactgcaacacccccaggcaccgctgatgccttccctcagtccaacgcacccatccaagacgaggaacgagacataccagagagatcatggaatagtgggaacgattggattaccgactttgccggaaagactgtctggttcgtgccgagcatcaaggctggtaatgatatcgccaactgccttcgcaaaaacggcaagaaagtgattcagctgtctaggaagacatttgacaccgagtaccagcgtacaaaactcaatgattgggacttcgtcgtaactacggatatctccgaaatgggggcgaactttaaggcagaccgggtgattgatcctagaaggtgtttgaagcccgttatactgaccgacggaccagagcgcgtgatcctcgccggccccatgcctgtcacagtggcttcagccgctcagcgaagaggtcgggttgggaggaatccacaaaaagaaaacgatcagtacattttcactggccagcccctgaataacgacgaggaccacgcacattggaccgaggccaagatgcttctagataatatcaacacacctgaaggaatcattccggctctgttcgagccagaacgcgagaaaagtgccgcaatagacggcgaatatcgtttgaagggggagagcagaaaaacctttgtggagttaatgcggaggggagatctgcccgtctggctcgcgcacaaggtggcctccgaaggtatcaaatacactgaccgcaagtggtgcttcgatggcgagcgaaataaccagattctggaagagaatatggacgtagaaatctggacgaaggagggggagaaaaagaaacttagacctcggtggctggatgctaggacctattctgaccccctcgccttgaaggaatttaaagatttcgcagctggacgcaagtcgattgccctggacctagtgacagagatcggcagagttccaagccacctggcacataggactcggaacgccctcgataatcttgtcatgctgcacacctcagaacatggtgggcgtgcttaccgccacgcggtggaggaattacctgagacaatggagaccttgctgctcctgggccttatgatactgctcactggaggcgccatgttgtttctgatctccgggaagggaattggtaaaacaagtatcggcttaatttgcgtggtcgcatctagcgggatgctatggatggctgacgttcccctgcaatggatcgcctccgccatagtgctcgaattctttatgatggtacttctgattccagagcctgaaaagcagcgaacgccgcaggataaccaattggcatatgtggtcatcggaattctgaccctcgctgccatcgtggcggctaatgagatgggcctgcttgagactacaaaaagagacctcggtatgtcaaaggaacccggggttgtgtctccaaccagctacctggacgtcgatttgcaccctgccagtgcatggaccctgtatgccgtagctacaactgtgataacgcccatgttaaggcataccatcgagaactccacagcaaatgttagcctagccgcgattgctaaccaggccgtggtcctgatgggcctcgacaaaggatggccaatctctaagatggatcttggcgtgcctctgttggcactggggtgttactcacaggtcaaccccctcactctgaccgccgctgtgcttttactggttacacactacgccattatcggaccgggcctccaggcaaaggctacccgggaagcccaaaaacgcactgcggccggtataatgaagaatccaacggtggacgggattatgacaatcgatttggaccctgtaatctatgattccaaattcgagaagcagctgggacaggtgatgctactggtcctctgcgcagttcagcttctgttgatgagaaccagttgggctttttgtgaagccctgactctcgcaaccggccccattacaactctgtgggagggtagcccaggcaaattctggaacaccacaatcgctgtgtcgatggccaatatatttagggggtcttacttagccggagcgggccttgctttctccattatgaagagcgtcgggacgggaaagcggggcaccggttcacaaggggagactctgggagaaaaatggaagaaaaagctcaaccagctaagtcgaaaagagtttgacctgtataagaaatctggcatcacagaagtggatagaaccgaggcaaaggaaggtttgaagcgcggcgagattactcatcacgccgtatccagggggagcgctaaactgcagtggttcgtggagcggaatatggttatccccgaaggacgtgtgatagacctcggctgcgggagaggaggctggtcatactattgtgccggtcttaagaaagtcacagaggtgagggggtacaccaagggaggccctggccatgaagagccggtccccatgagtacgtatgggtggaacatcgtgaaactgatgagcggaaaggatgttttctacttgccacctgaaaagtgcgacaccctgctctgtgatattggtgagtcctctcccagccctacagtagaggaatcccgcactatccgggtgttaaaaatggtcgagccatggctgaagaataaccagttttgcattaaagtgcttaatccctacatgcctaccgttatcgaacacctggagcgactacaaagaaagcacggcgggatgctcgtgaggaacccactgtcacgcaattctacacatgagatgtattggattagtaacggaactggcaatatcgtctcgagcgtgaacatggtatcccggttgctgctcaatagattcaccatgacacaccgtaggcccaccatagaaaaagacgtggaccttggtgcagggactcggcatgttaacgccgagccggaaacgcctaacatggatgtcattggagagcgcatccgaagaatcaaggaagagcactcttcaacatggcactacgacgatgagaatccatataagacctgggcttaccatggcagctatgaagtgaaagcgactggctccgccagttctatgattaacggggtggtcaagctgttaaccaaaccctgggacgttgtgcctacagtaacgcagatggcaatgaccgatactacaccatttggacagcaaagggtgttcaaggagaaagtcgacacccggactccccgcccgatgcctggtacaagaaaggtgatggaaataaccgctgagtggctgtggaggacattgggccgaaataagcggccccgtctctgtactagagaagagtttaccaaaaaggttcgcacgaacgccgcaatgggggccgtgttcaccgaggaaaatcagtgggatagcgctagggccgcggtcgaggacgaagagttttggaaactggtggatcgggaaagagagctacacaagcttggaaaatgcggctcatgtgtatacaacatgatgggtaagcgcgagaaaaagctgggggaattcggaaaggcaaaaggctccagggccatctggtatatgtggctcggcgctcgatacctggagtttgaagccttggggttcctgaatgaggaccattggtttagtcgggagaacagctactctggagttgaaggtgagggcctccacaagcttgggtatattctgagagatatctccaaaattccaggaggcgcaatgtacgctgacgacacagccggttgggatactaggatcaccgaagacgatttacataatgaggaaaagataacacagcagatggaccctgagcaccgccaactggctaacgccatcttcaaattgacttatcagaataaggtggtcaaggtgcagcgtcccaccccaaaagggacggtgatggatattatctcacggaaggaccagagaggaagcggccaagtcggcacatacgggctcaacacctttactaatatggaggcacagctgattaggcagatggaaggagagggtgttctatcgaaagcggatcttgaaaacccccacctgctcgagaagaaaatcacacagtggctggaaaccaagggcgtggagcgcttgaagcgaatggccatatctggggacgattgcgtagtgaaacctattgacgatcggttcgctaatgccttactggcactcaacgacatgggaaaggtcagaaaagatatcccacaatggcagccgagtaagggctggcatgactggcagcaggtgcccttctgctcccaccattttcacgagcttatcatgaaagacggtaggaagctggttgtgccttgtcgcccacaagatgaactaattgggagagctcggataagccagggagccggctggtcactgaaggagactgcatgcctcggcaaagcctatgcgcagatgtgggctttgatgtacttccacaggcgtgacctgcgacttgcctccaacgcaatctgttctgccgtccccgtgcattgggtacctaccagccgcacaacgtggagtattcacgctcatcaccaatggatgaccactgaagatatgctgacagtttggaatagagtgtggatcgaggacaacccatggatggaagataagacccccgtcactacatgggaggacgtgccttatctcgggaaacgggaggatcagtggtgcggatccttaattggtctgaccagcagggccacgtgggcacagaatatcttgacagctatacagcaagttcgctctctgatcggcaacgaagagtttctcgactacatgccgtcaatgaagagattccggaaagaagaggagagtgaaggggccatttggtga

SEQ ID NO: 15664 - RNA, 9873 nt, synthetic construct
  misc_feature 1..9873: note = derived and/or modified CDS sequence (opt3) from DENV-3__AY858039__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagagcacaaacgtggatgtccgccgagggggcttggaggcaggtcgaaaaagtggagacttgggcattccggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacgtcacgaccgatagccggtgccctacacagggcgaagctattttgccagaggaacaggaccagaattatgtttgtaaacacacttacgtggatcgcggttgggggaacggatgcggcctctttggcaaggggagtctggtaacctgcgccaagttccaatgtttagagctgatcgagggaaaagtggtccagcacgaaaatctcaagtatacagtgataattactgttcataccggtgaccagcaccaggtgggcaacgagacacaaggggtcaccgcagaaatcactccccaggcttccacggtggaggccattcttcctgaatacggaacactgggcttggagtgctctccacgaaccggtctagactttaatgagatgatcctgctcactatgaaaaacaaggcgtggatggtacatagacagtggttctttgatctgccgcttccctggaccagcggggccacaaccgaaactcctacatggaataaaaaggagctgttggttacgttcaaaaacgcacacgctaagaagcaagaagtggtcgtgctcggctcccaggagggagccatgcacaccgctctgactggcgccacagaaatccagacctcagggggaacaagtatttttgcaggtcatttaaaatgtaggctgaagatggacaaactagagctcaagggcatgagctatgccatgtgctctaatgctttcgtcctgaaaaaggaggtgtccgaaactcagcacgggaccatacttatcaaggttgagtacaaaggagaagatgcgccatgtaagattcccttctcaacggaggacggccaaggtaaagcacataacgggcggttgatcaccgccaaccctgtggtaacaaagaaagaggaaccagtcaatatagaggctgaacccccgtttggcgagagcaacattatcatcggaattggcgataaggccctgaagatcaattggtacaaaaaggggagttctattggaaaaatgttcgaagcaactgcccgtggtgctcgcagaatggccatactcggcgacaccgcatgggattttgggtccgtgggaggcgttctgaacagccttggtaagatggtgcaccagatcttcgggtcggcgtatacagctctgttttctggcgtctcctggattatgaaaatcggaatcggcgtgttgctcacttggattgggctgaattcaaagaacaccagtatgagcttctcctgcatagtaatcggaattatcacgttatacctgggcgccgtggttcaggcagacatgggttgtgtcattaattggaaggggaaagagctaaagtgcggatctggcatctttgtgacaaacgaggtgcatacctggactgaacagtataaattccaagccgatagccctaagaggctcgctacagccatagcaggtgcttgggagaatggcgtctgtgggatccggtcaaccactcgaatggaaaacctgctttggaaacagattgccaatgagttgaactacatcctgtgggaaaataacattaagctcaccgttgtggtgggagacatcataggcgtactggagcaggggaaacgcacattaacgccccagccaatggagctgaagtatagttggaagacctggggaaaagcgaagattgtcactgccgaaatccaaaattccagctttattatcgatggccctaacacacccgagtgcccaaacgcttctagagcatggaatgtgtgggaagttgaggactacggtttcggggtgtttaccacaaacatatggcttaaattgagggaaatgtatactcagctctgtgaccaccggctgatgtcagccgctgtcaaggatgagcgcgccgtgcacgcagacatgggatactggatcgagagtcagaaaaatggcagctggaagctagaaaaggcgtccctgattgaggttaaaacctgcacgtggcccaagtctcatacactctggtcgaacggtgtgctggaaagcgatatgatcattcctaaatcccttgccggcccaatctcacagcacaattacagaccggggtatcatacccaaactgctggaccctggcacttgggcaagctggagttagacttcaactactgcgaggggaccacagtagtcataactgaaaattgtggaaccaggggccctagtctccgtacaacgaccgtgtctggtaaactgattcacgagtggtgctgtcggagctgcactcttccacccctgcgatatatgggggaagatggatgttggtacggcatggagatcagacctatcaacgaaaaggaggagaatatggtgaagtccttggtctcagccggtagcggcaaagttgacaactttacaatgggggtgctctgcctggcaattctattcgaagaggtaatgaggggaaagttcggcaaaaagcatatgatcgctggggtgctgtttattttcgtcctcctgctttctggacagataacctggcgcgatatggcccggactttgatcatgattggctccaatgcaagtgacagaatgggtatgggggtgacatatctggccttaatcgctacctttaaaattcagccattcctcgcgctgggatttttccttaggaagctgacgagccgcgaaaacctactcctgggcgttggcttggccatggcaactaccctgcaattacccgaggatatcgaacagatggctaatgggatagccctcggactgatggcccttaagctgatcacacagtttgagacctaccagttgtggactgctctcgtgtctctgacatgttccaacaccattttcacactaactgtcgcatggcgaaccgccacgctgatccttgcgggtatttcactcctgccggtgtgccaaagtagctcgatgcggaaaacagactggttgcctatgaccgttgctgccatgggcgtgccaccctcccctctgtttatcttctctttaaaggatactctcaaacgtagaagctggcccctgaatgagggggtcatggcagtaggacttgtgtcaatactggccagttccttgctcaggaacgacgttccaatggctggccctctggtggcaggtgggctactgattgcctgttatgtcatcaccggaacatctgcggatcttactgtggaaaaggctgccgacgtaacctgggaggaagaggcagaacagacgggcgtgagccacaacctcatgatcacagtcgacgatgacggcaccatgcgcattaaagatgacgagactgagaatatactgacagttttgttaaagaccgccctgctcatcgtgtccgggatttttccctactcaatcccagctactctgcttgtgtggcatacatggcagaaacagacccaacggagcggagtcctgtgggatgtgccgagtcctcccgaaacgcagaaggccgagttggaagagggtgtttacagaattaagcagaggggcatcttcgggaaaactcaggtaggagtgggcgtccaaaaggagggtgtgtttcacaccatgtggcatgttacacgaggggcagtgctaacctataacggaaaacgcctggaaccaaattgggcttctgtcaagaaagacctcatatcctacggcggcgggtggcggctgagcgcccagtggcagaagggagaggaagtgcaagtaatcgcggtcgagcccggtaagaaccctaaaaatttccagacaatgccaggcattttccagactaccacgggggaaatcggagccattgcacttgattttaagcccggcacatcgggttcacctatcataaacagagaggggaaagtggttggattatatggcaatggcgtggtcactaagaacgggggatacgtgtctggtattgctcagaccaatgccgagccggacggcccaacacccgaactggaggaagagatgttcaaaaagaggaacctcaccatcatggatttgcaccctgggagtggaaagactcgtaaatatctgccagctatcgttcgcgaagcaattaagcggagactcaggaccctgatccttgcccccacacgagtggtcgccgctgagatggaggaagcgctgaaaggcttgcctatacggtaccaaacgactgcaaccaagtccgagcacacaggtaaagaaattgtggacctaatgtgccatgccacctttactatgcgcctgctcagcccggtaagagtgcccaattataacttaatcattatggatgaggctcacttcacagacccagcctctatcgcagccagggggtacataagcacccgggttggaatgggcgaagctgcggccatttttatgacggcaactcctcccggcacagctgatgccttcccacagtccaatgcacctatccaggacgaggagcgagacatccccgaaagatcatggaacagtgggaatgattggattaccgactttgccggaaagaccgtctggttcgtgccaagcatcaaggctggtaacgatattgccaactgtctgcgcaaaaatggcaagaaagtgatacagctttctaggaagacttttgacacagagtaccaaaaaaccaagctgaacgattgggacttcgtcgtaacaactgatatctccgaaatgggggcgaattttaaggcagaccgtgtgattgatccgcggagatgcctcaaacctgttatcttgacggacggacccgagagggtgatcctggccggcccaatgcccgtcaccgtggcttcagccgctcagcgccgaggtagagttgggcggaaccctcagaaggagaatgatcagtatattttcacaggccaaccactcaacaatgacgaagaccatgcacactggactgaggccaaaatgctgcttgataacataaatacccccgaaggaatcattcctgctctattcgagccggaaagggagaagagtgccgcaatcgacggcgagtaccgcctgaaaggggaaagccgtaagacatttgtggagttgatgagacggggagatttaccagtctggctggcgcataaagtggcctccgaaggtattaagtataccgacaggaagtggtgcttcgatggcgagcgcaacaatcagatcctcgaagagaacatggacgtagagatatggactaaagaaggggagaagaaaaagctgcgacccagatggcttgatgctcggacgtactctgaccctctggccctcaaagaatttaaggatttcgcagctggaaggaagtcgatcgccttggacctggtgaccgagattggccgcgttcccagccacctagcacacagaacaaggaatgccctggataacctcgtcatgcttcatacttcagaacacggtgggcgggcttatcgtcatgcggtggaggagctgccagaaaccatggagacattattgctgctcggcctgatgatccttctgaccggaggcgccatgctctttttgatttccgggaaaggagtgggtaagactagtatcggcctgatatgtgtcgttgcatctagcgggatgttatggatggctgacattcctctacagtggatcgcctccgccattgtgctggaattctttatgatggtactccttatccccgagccagagaaacagcgcacacctcaagataatcagctggcatacgtggtcataggaatcttgacgctggctgccattgtggcggctaacgaaatgggcctcctggagaccactaagcgagaccttggtatgtcaaaagaaccgggggttgtgtctcccacaagctatctcgacgtcgatctgcacccagccagtgcatggaccttgtacgccgtagctaccacagtgatcactcctatgctgagacacacgattgagaattccaccgcaaacgttagcttagccgcgatcgctaaccaggccgtggtcctaatgggcctggacaagggatggcccatatctaagatggatctcggcgtgccacttctggcattggggtgctactcacaagtcaatcctctgacactcactgccgctgtgctgcttttagttacccattatgccattatcggacccggcctgcaggcaaaagctacaagggaagcccagaagcggaccgcggccggtatcatgaaaaacccgactgtggacgggattatgacgatcgatctcgacccagtaatatacgattccaagttcgagaaacagttgggacaagtgatgctgctagtcctgtgtgcagttcagctccttctgatgcgcacaagttgggctttttgcgaggccttgaccctggcaactggccctattaccacactctgggaaggtagccccggcaagttctggaatactaccatcgctgtgtcgatggccaacatttttagagggtcttatctggccggagcgggcttagctttctccatcatgaagagcgtcgggacaggaaaaaggggcacgggttcacagggggagacccttggagaaaagtggaaaaagaaactgaatcagctcagtcggaaggagtttgacctatacaaaaagtctggcataactgaagtggatcgaacagaggcaaaggagggtctgaaaagaggcgaaatcacccaccatgccgtatcccgcgggagcgctaagttgcaatggttcgtggagaggaacatggttattccagaaggacgggtgatcgacctgggctgtgggcgtggaggctggtcatattactgcgccggtctcaaaaaggtcactgaggtgagagggtatacaaaaggaggccccggccacgaagagcctgtcccgatgagtacctacgggtggaatattgtgaagcttatgagcggaaaggatgttttctacctgcccccagagaaatgtgacacgttgctgtgcgatatcggtgaatcctctcctagccccaccgtagaggaatccaggacaattcgcgtgctcaagatggtcgagccttggttaaaaaacaatcagttttgtatcaaggtgctgaacccatatatgcccactgttatagagcatcttgaacggctgcagcgaaaacacggcgggatgctagtgagaaatcctctctcaaggaactctacccacgagatgtactggattagtaatggaacaggcaacatcgtctcgagcgtgaatatggtatcccgcctgttgctgaaccggttcactatgacctatagacgtccaacaatcgaaaaggacgtggacctcggtgcagggaccaggcatgttaacgccgagcccgaaactccgaatatggatgtcattggagagcggatacgccgaatcaaggaggaacactcttcaacgtggcattacgacgatgagaacccttataaaacatgggcttaccacggcagctatgaagtgaaggcgaccggctccgccagttctatgattaatggggtggtcaaacttctgactaagccatgggacgttgtgcccaccgtaacacagatggcaatgacggataccactccttttggacaacagagagtgttcaaagagaaggtcgacacaaggaccccaaagcccatgccgggtactcggaaagtgatggaaatcacagctgagtggttatggcgcaccctgggcagaaacaagaggcctcgattgtgcacacgggaggaatttactaaaaaggttcgtaccaatgccgcaatgggggccgtgttcacggaggaaaaccagtgggatagcgctagagccgcggtcgaggacgaagagttttggaaactcgtggatcgcgagagggaactgcacaagctaggaaaatgtggctcatgcgtatacaatatgatgggtaagcgggagaagaaacttggggaattcggaaaggcaaaaggctccagagccatttggtacatgtggctgggcgctcgctatctcgagtttgaggccctggggttcttgaacgaagaccattggtttagtagggagaatagctactctggagttgaaggtgagggcctgcacaagctcgggtatatccttcgagatatatccaaaatccccggaggcgcaatgtacgctgacgacaccgccggttgggatacacggattactgaagacgatctgcataacgaggagaagatcacccaacagatggacccagaacacagacagttagctaatgccattttcaagctgacatatcagaacaaagtggtcaaggtgcaaaggcctactcccaaagggaccgtgatggatatcatatcacgcaaggaccagcgtggaagcggccaggtcggcacgtacgggttgaatacatttaccaacatggaggcacagctcattcggcaaatggaaggagagggtgttctgtcgaaaactgatctagaaaatccacatcttctggagaagaagatcacacagtggctcgagaccaaaggcgtggaaagactgaagaggatggcgatctctggggacgattgcgtagtgaaacccattgacgatcgcttcgccaacgctttgttagccctgaacgacatgggaaaggtccgaaaagatatacctcagtggcagccaagtaagggctggcacgactggcaacaggtgccgttctgttcccaccattttcacgagctcatcatgaaggacggtcggaaacttgttgtgccctgcagacctcaggatgaactgattgggagggcacgcatcagccagggagctggctggtcactaaaggagactgcctgtctgggcaaagcatatgcccaaatgtgggcgctcatgtacttccatagacgggacttgaggctggcttccaatgccatttgctctgcagtcccagtgcactgggtacccaccagccgtacaacgtggagtatccacgcccatcaccagtggatgaccactgaagatatgcttacagtttggaaccgagtgtggatagaggacaatccttggatggaggataagaccccagtcactacatgggaagacgtgccctacctggggaaacgcgaggatcagtggtgtggatccctcatcggtttaaccagcagagctacgtgggcccaaaacattctgacagcaatccagcaggttcggtctttgattggcaatgaagagtttctggactatatgccttcaatgaagaggttccgcaaggaggaagagagtgaaggggctatctggtga

SEQ ID NO: 15665 - RNA, 9873 nt, synthetic construct
  misc_feature 1..9873: note = derived and/or modified CDS sequence (opt3) from DENV-3__JN368477__SS-prME
  source 1..9873: mol_type = other RNA
accagcctgtgcctcatgatgatgcttcccgcaacactggctttccacttgacttccagagacggcgaacctaggatgatcgtggggaagaacgaacggggaaaatctttactgtttaagacggcatcaggtattaatatgtgtaccctaatagccatggatctcggcgagatgtgcgacgatacagtaacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccagacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcaaagagcaaacccacactcgacatcgagctgcagaagaccgaagcaactcagcttgccacactgaggaaattgtgtattgagggaaagatcaccaatattacgaccgatagtcggtgccctacacagggcgaagctactctcccagaggaacaggaccagaactatgtctgtaaacacacctacgttgatcgcggttgggggaatggatgcggcctgttcggcaaggggtccttagtgacatgcgccaagtttcaatgtctggagcccatcgagggaaaagtagtgcagtatgaaaacctcaagtacactgtcataattaccgtgcacacaggtgaccagcatcaggttggcaatgacacccaaggggtgactgtcgagatcacgcctcaggcatctacagtggaagctgtacttccagagtatggaaccctgggcttggaatgcagcccgcgaactggtctagatttcaacgagatgattctgctcaccatgaaaaataaggcctggatggttcacagacagtggtttttcgacctgccccttccttggacatccggggcgaccactgagacaccaacgtggaacaggaaagaactgttggtgacctttaagaatgcccatgccaagaagcaagaggtcgtggtcctcggctcacaggaaggagctatgcacactgccctgacaggcgctaccgagatccagaacagtgggggaacaagcatcttcgccggtcacttaaagtgtcggctgaaaatggataagctagaactcaaaggcatgtcttacgcaatgtgcctgaatacttttgtgcttaagaaagaggtttccgagacccagcatgggacgattttgataaaggtggaatacaagggagaggacgccccctgtaaaatccctttctcaaccgaagatggccaaggtaaggctcacaacgggcgtctgattacagcgaacccagtagtcactaaaaaggaggagcccgtgaatatcgaagcagagccgcctttcggcgaaagcaacatagttattggaatcggcgacaaagccctcaagatcaattggtataagaaagggagttctattggaaagatgtttgaggctaccgcccgcggtgcaagaaggatggccatcctgggcgatacagcttgggacttcgggtccgtgggaggcgtccttaacagcctgggtaaaatggtgcatcagatttttgggtcggcctacactgcattgttctctggcgtatcctggataatgaagatcggaattggcgtgctcctgacctggatcgggttaaatagtaaaaacacgtcaatgagcttttcctgcatcgttattggaataatcacactgtatctaggcgcggtcgtgcaggctgatatgggttgtgtgattaattggaaggggaaggaactcaaatgcggaaacggcatcttcgtcaccaatgaggttcacacttggacagagcagtacaagtttcaagccgactctcccaaacggctggcaaccgccattgctggtgcctgggaaaacggcgtgtgtgggatccgaagcactacccgcatggagaatcttttgtggaagcagatagcaaacgaactgaattatatcctctgggagaacaatattaaactgacagtggtagtcggagatatcattggcgtgttagaacaggggaagagaacgctgaccccacagcctatggagcttaaatactcatggaagacttggggaaaggctaaaatcgttacagccgagacccaaaacagttccttcataattgacggccccaacacaccagaatgccccagcgcgtctagggcctggaatgtgtgggaggtcgaagactatggttttggggtgttcactaccaacatctggttgaagctccgggaggtttacacgcagtcatgtgatcatcgcctgatgagtgctgcaattaaagacgaaagagccgtgcacgctgatatgggatactggatcgagagccagaagaatggctcctggaaactagagaaggcctcttttatagaagtaaagacatgcacctggcctaaatcgcacactctgtggagcaacggtgtcctcgagtccgacatgatcattccaaagtcactggcaggcccgatcagtcagcataatcacaggcccgggtatcatacccaaacagcgggaccttggcaccttggcaaattggaactggatttcaactactgcgaggggactaccgtggtgattgccgagaattgtggaacacgtggcccatctttacggacgaccactgtcagcggtaagctcatccacgaatggtgctgtcgatcctgcacactgccccctcttagatatatgggggaggacggatgttggtacggcatggaaataaggccaattaacgagaaagaagagaatatggttaagtcactggtgagcgctggttctggcaaggtagataactttaccatgggggtgttgtgcctcgccatcctgttcgaggaagtcatgcgcggaaaattcggcaagaaacatatgatcgcaggggtgctatttactttcgttctgctcctgtccggacagattacatggcgggacatggctcacacccttatcatgattggcagtaatgccagcgatagaatgggtatgggggtgacgcatttggcactgatagccacttttaagatccagcccttcttagctctcggatttttcctgaggaaacttacctctcgcgagaacctgctactcggcgtcggcctggcgatggccacaaccttgcaactgccggaagacattgagcagatggcaaatgggatcgctttaggactcatgactctgaaacttattacacagtttgaaacctatcagctgtggacagccttggtgtccctcacttgttcaaacaccatcttcacgctgacagttgcctggcgaaccgctactctaatactggcgggtgtgagtcttctccctctgtgccaaagctcgtccatgcggaagaccgattggttgccaatgacagtcgccgcgatgggcgtaccccctctgcccttatttatcttctctctcaaagacactccaaagcgtagaagctggcctctgaatgagggggtgatggctgttggacttgtgtcaattctggccagttccttgctcaggaacgatgtccccatggcaggcccactggtggccggtgggctactgatcgcttgttacgtaattaccggaacgtctgcagaccttacagtggagaaagccgcggacgtcacctgggaagaggaagctgagcagactggcgttagccacaacctcatgatcacagtggatgacgatggcaccatgcgcataaaggacgatgaaactgagaatattctgacagtgttgttaaaaaccgccctgctcatcgtctccgggatctttccgtattcaattcctgcaacgctgcttgtgtggcatacttggcagaagcagacccaacggagcggagttctgtgggacgtacccagtccacccgagacacagaaagccgaattggaggaaggtgtgtacagaataaagcagcagggcatcttcgggaagacccaagtcggagtgggcgttcagaaagagggtgtgtttcacacaatgtggcacgtcactagaggggctgtgctaacccataacggaaagcgactggagcctaattgggcctctgtcaagaaggatctcatttcctacggcggcgggtggcgcctgagcgcacagtggcaaaaaggagaagaggtccaggtgatcgctgttgaaccaggtaagaaccccaagaatttccagacgatgcctggcattttccagacaactaccggggagatcggagccatagcgcttgactttaaaccgggcacatcgggttcaccaatcattaaccgggaagggaaggtggtcggattatatggcaatggcgtggttaccaaaaacgggggatacgtgtctggtatcgcccaaactaatgcagagcccgatggccctaccccagagctggaagaggaaatgttcaagaaaagaaacctcacaattatggacttgcaccccgggagtggaaagacgaggaagtatctgcctgctatcgtccgtgaggccataaaacgccggctcagaactctgattcttgctccgaccagggtggtagcagccgaaatggaggaggccctgaagggcttgcccatccgataccagacaaccgctactaaatccgaacatacaggtcgggagatcgtggatctaatgtgccacgcgacctttacgatgcgcctgctcagcccagttagagtccctaattataacttagtgattatggacgaagcacatttcactgatcccgcctctatcgctgccagggggtacataagcacacgggtgggaatgggcgaggcagccgctatttttatgaccgcgaccccacctggcactgccgaagcattcccccagtccaatgctccaatccaggacgaggagcgagacattccggaaagatcatggaacagtgggaatgagtggatcacagattttgtcggaaagaccgtatggttcgtgcctagcataaaagccggtaacgacattgcaaactgtctgcgcaagaatggcaagaaagttatccaactttctaggaagacatttgatactgaatatcagaaaacgcgtctgaacgactgggatttcgtggtcaccacagacatctccgagatgggggccaattttaaggctgatcgggtgattgaccccagaaggtgcctcaaaccagttatcttgactgatggacccgagcgcgtgattctggccggccctatgccagtcaccgcggcatcagccgctcagcgaagaggtcgggtggggaggaacccccagaaggaaaatgaccaatacatattcacaggccagcctctcaacaatgatgaggaccacgcccactggaccgaagctaagatgctgcttgacaacatcaatactccggagggaattatcccagcactattcgaacccgagcgcgagaaaagtgccgctatcgatggcgaataccgtctgaagggggagagcagaaaaacgtttgtagaattgatgcggaggggagacttacctgtgtggctggcccataaggttgcatccgagggtattaaatataccgatcgcaagtggtgcttcgacggcgaacgaaacaatcagatactcgaggagaacatggatgtcgaaatctggacaaaagagggggaaagaaagaagctgcggcccaggtggcttgacgcgcgcacttactctgatccactggccctcaaagagtttaaggacttcgctgccggaagaaaatcgattgcattggatctggtgaccgaaatcggcagggtgcctagccacctagctcatcggacacgtaatgccctggacaacctcgtcatgcttcacacctcagagcacggtgggcgcgcatatcgacatgccgttgaggaactgcccgagactatggaaacattattgctgctcggcctgatgattcttctgacgggaggcgctatgctctttttgatctccgggaagggaataggtaaaaccagtatcggcctgatttgtgtgatcgtatctagcgggatgttatggatggcggatgtgccactacagtggattgcctccgcaatcgtcctggagttctttatgatggtgctccttatacctgagccggaaaagcaaagaactccccaggacaatcagctggcttacgttgtgattggaatcttgacactggccgccattgtcgcagctaacgagatgggcctcctggaaaccaccaagagggatcttggtatgtcaaaagagccaggggtagtgtctcctacaagctatctcgacgttgacctgcaccccgccagtgcgtggactttgtacgctgtggccacgaccgtcatcacaccaatgctgcggcatactatagaaaattccaccgcaaacgtgagcttagccgctatcgcaaaccaagccgtcgtgctaatgggcctggataagggatggcctatttctaaaatggacctcggcgttccccttctggcgttggggtgctattcacaggtgaatccgctgacactcaccgctgccgtactgcttttagtgactcactacgcaatcattggaccaggcctgcaggccaaggctacgcgcgaggcccagaaaagaacagcagctggtatcatgaagaaccctaccgtcgatgggataatgactattgacctcgatcccgttatctacgactccaagttcgagaaacaattgggacaggtgatgctgctagtcctgtgtgccgtgcagctccttctgatgaggaccagttgggcgttgtgcgaagccctgacactcgcaactggcccaatcaccacactgtgggagggtagccccggcaagttttggaatacgaccattgctgtatcgatggccaacatcttccgggggtcttatttagcaggagctggccttgccttttccataatgaaaagcgtggggactggacgaagaggcacaggttcacagggggaaaccctgggagagaagtggaaaaagaagctcaatcaactaagtcgcaaagagttcgatctgtacaagaaatctggcattactgaggttgacaggacagaggccaaggaaggtttgaaacggggcgagaccacgcatcacgcggtgtcccgtgggagcgctaagctgcagtggtttgtcgaaagaaacatggtgatccctgagggaagggtcattgatctcggctgtgggcgcggaggctggtcatattactgcgcaggtcttaaaaaggtgaccgaagttcgggggtatacaaagggaggcccgggccacgaggagcccgtaccaatgagtacttacgggtggaatatcgtgaaactgatgagcggaaaggacgtcttctatttgcctcccgaaaaatgtgataccctgctctgcgacataggtgagtcctctcctagcccaacagtggaagagtcccgaactatcagagttttaaagatggtggagccctggctgaggaacaatcagttctgtattaaagtccttaacccttacatgccaaccgtgatcgaacatctggagcgcctacagcggaagtacggcgggatgctcgtaagaaatcccctgtcacgtaactctacacacgaaatgtattggattagtaatggaaccggcaacatcgtgtcgagcgttaatatggtctccaggttgctgctcaaccggtttactatgacgcatcgccgaccgacaattgagaaggatgtggaccttggtgccgggaccagacacgtgaacgctgaacctgagactccaaatatggacgtcatcggagagaggataaaacggattaaggaagaacactcttcaacctggcattacgatgacgaaaacccctataaaacatgggcctaccacggcagctatgaggttaaggcaacgggctccgccagttctatgatcaatggggtggtaaaactgttaaccaagccttgggatgtggtcccaatggtgactcaaatggctatgacagacaccactcccttcggacagcagcgcgtttttaaggaaaaagtggatacaagaaccccgaggcctatgcccggtacacgaaaggtcatggagatcactgcggagtggctgtggcggaccttgggccgtaacaaaaagccaagactctgcacgcgcgaagagttcaccaaaaaggtgaggacaaatgccgcaatgggggctgtatttactgaagagaaccaatgggacagcgcccgggcagccgttgaagatgaggagttctggaagctggtggacaaagaaagagagctacataaacttggaaaatgtggctcatgcgtctacaatatgatgggtaagcgcgagaagaagctgggggagtttggaaaagctaagggctccagggccatttggtatatgtggctcggcgcgcgatacctggagttcgaagcattggggtttctgaacgaggatcactggttcagtcgggaaaatagctactctggagtggagggtgaaggcctccataaacttgggtatatactgagagacatctccaaaattcctggaggcgccatgtacgctgatgacaccgccggttgggacacaaggatcactgaggatgacttacacaacgaggaaaagattacccagcagatggatcccgggcaccgccagctggcaaatgctatctttaaattgacgtatcaaaacaaggtggtcaaagttcagcgtccaacacccaagggaaccgtgatggacataatctcacggaaggatcagagaggcagcggccaggtagggacttacggactcaatacattcaccaacatggaggcccaactggtgaggcagatggaaggtgagggcgtcctatcgaaagctgaccttgaaaatcctcatctgctcgagaagaaaattactcagtggctggagaccaagggggtggaacgcttgaaacgaatggccatctctggagatgactgcgttgtgaagccaattgatgaccggtttgcaaacgcgttactggccctcaacgatatgggcaaggtcagaaaagacatcccgcagtggcaacccagtaagggttggcacgattggcaacaggtgcctttctgttcccatcacttccacgagcttataatgaaagacgggaggaagctggtagttccatgccgcccccaggacgaactaattggaagggctcggatcagccaaggcgccggctggtcactgaaagagacagcatgtctcgggaaggcttatgcccagatgtggtccttgatgtactttcataggcgtgatctgcgacttgcatctaatgccatctgcagcgcggtgcctgtccactggattccaacgagtcgcaccacttggtccatacatgctcaccatcagtggatgacaaccgaagacatgctgactgtgtggaacagagtttggatcgaggataatccctggatggaggacaagacacctgtgaccacgtgggaagatgtcccgtatctcggaaaacgggaggaccaatggtgtggtagcttaattggcctgacatctagggccacctgggcacagaacatcttgactgccattcaacaggtgcgctcactgatcggggatgaagagttcctcgactacatgccaagtatgaagagatttcggaaagaggaagagaccgaaggagctatatggtga

SEQ ID NO: 15666 - RNA, 9873 nt, synthetic construct
  misc_feature 1..9873: note = derived and/or modified CDS sequence (opt3) from DENV-3__EF643017__SS-prME
  source 1..9873: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcgccgacgtgacaagagaagcgtagcccttgcaccccacgtgggcatgggtctggatacaaggacccaaacgtggatgtccgccgagggggcttggcggcaggtcgaaaaagtggagacttgggcattgcgccatcctggattcaccattctcgccctgtttctggctcactacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcatggcgggtgcgtgacgactatggcgaagaataaacccacactagacattgagctccagaagaccgaagcaactcaactggccacacttcggaaactgtgtatcgagggaaagattaccaacatcacgaccgatagccgctgccctacacagggcgaagctgtcttgccagaggaacaggaccagaattatgtttgtaaacacacttacgtggatcgaggttgggggaacggatgcggcctcttcggcaaggggagtctggtaacctgcgccaagtttcaatgtttagagcccatagagggaaaagtggtccagtatgaaaatctgaagtacacagtgattatcactgttcacaccggtgaccagcatcaggtgggcaacgagacacaaggggtcaccgcagaaattactcctcaggcttccacgacagaggccatcctcccagaatatggaacccttggcctggagtgctctccgagaactggtttggacttcaatgagatgatcctactgaccatgaaaaacaaggcgtggatggtgcacaggcagtggtttttcgatctccccctgccttggacaagcggggccaccactgaaacaccaacgtggaatcggaaagagcttctggtaacctttaagaacgcacatgctaaaaagcaagaagttgtggtcttgggctcccaggagggagccatgcacactgctctcacaggcgccaccgaaattcagaattcagggggaacaagtatattcagcggtcacctgaagtgtcgtttaaaaatggacaagctggagctaaaaggcatgtcttacgcaatgtgcactaacacctttgtgctcaagaaagaggtctccgaaacgcagcatgggaccatcctgattaaggtggagtaccgcggagaagatgccccctgtaagatccctttctcaacagaggacggccaaggtaaagctcacaacgggagacttataactgcgaatccagttgtgaccaagaaagaggaacccgtaaacattgaggcagaaccgcctttcggcgagagcaatatcgtcatcggaattggcgataacgccttgaagatcaattggtataaaaaggggagttctattggaaagatgtttgaagctacagccaggggtgcacggcgaatggccatactgggcgacactgcttgggatttcgggtccgtgggaggcgttctcaacagcctgggtaaaatggtgcatcagatctttgggtcggcctacaccgcacttttctctggcgtctcctgggtgatgaagattggaatcggcgtactgttgacgtggatcgggctcaattcaaaaaacacaagtatgagcttttcctgcattgcgataggaatcattaccctgtatttaggcgctgtggttcaggccgacatgggttgtgtcatcaattggaaggggaaagagctgaagtgcggatctggcattttcgtgactaacgaggtgcacacatggaccgaacagtacaagtttcaagcagatagccccaaacgcctagccactgctatcgccggtgcatgggagaatggcgtctgtgggataagatcaaccacaaggatggaaaacctcctgtggaagcagatcgctaatgagcttaactatattttgtgggaaaataacatcaaactgacggttgtggtgggagacattatcggcgtactcgagcaggggaagcggaccctgactccacagcctatggagttaaaatacagttggaagacatggggaaaagccaagatagtcaccgcggaaacacaaaactccagcttcattatcgatggccccaatactccagagtgcccctctgcctcacgcgcttggaacgtgtgggaagttgaggactatggttttggggtgttcaccacgaatatttggctgaagcttagagaagtctacacacagttgtgtgaccataggctcatgagtgcagccgtgaaagatgagcgtgctgttcacgccgacatgggatactggatcgagagccagaagaacggctcctggaaactggaaaaggcatctctaatagaggtgaaaacctgcacttggcctaagtcgcacaccctgtggagcaatggtgtactcgaatccgatatgatcacaccaaagtcactggcgggcccgattagtcagcataaccaccggcccgggtatcatactcaaaccgccggaccttggcaccttggcaaattggagctggactttaattactgcgaggggacaacggtcgtgatcaccgaaaactgtggaactcgaggcccatctttaagaacaaccactgtgagcggtaagctcattcacgagtggtgctgtaggtcctgcacactgccccctcttcgctatatgggggaagatggatgttggtacggcatggagatccggccaatatcagaaaaagaggagaatatggtcaagagcctggtttctgctggttccggcaaagtggacaacttcaccatgggggtattgtgcctcgccattctgtttgaagaggtgatgagaggaaagttcggcaagaaacatatgatcgcaggggtcttctttacgttcgtgctactgctcagtggacagatcacttggagggatatgacccacacactgattatgatcggcagcaatgcttctgaccgcatgggtatgggggttacctatcttgccttgattgcaacttttaagatacagcccttcctggccttaggatttttcctccgaaaactgacatcccgggaaaaccttctgctaggcgtgggcctcgctatggcgaccacactgcaattgccggaggatatcgaacagatggccaatgggattgcactgggattaatggctctcaagctgatcactcagtttgagacctaccagctttggacggccctgatttcattgacatgtagtaacaccatgttcactctcaccgtcgcctggcgtacagctactctgatcctagcaggtgtgagcctgcttcctgtttgccaatcgtcctctatgagaaaaaccgactggctcccaatggccgtggcggctatgggcgtcagccccctgcctttgtttatattctcactgaaggatacgttaaagaggcgcagttggcccctcaatgagggggtaatggccgtgggactggtttccatccttgcatctagcctgttgcggaacgacgtgccaatggccggccctctcgtcgctggtgggctgctaattgcatgttatgtgatcacaggaacctccgccgatctgactgtagaaaaagcggctgacattacaagagaggaagaggccgaacagaccggcgtgtcacataaccttatgactacagtcgacgatgacggcaccatgaggatcaaggatgacgagacggagaatatactcactgttctgttgaaaaccgcattactgattgtgagcggggtgtttccctacagtatcccagccacactcctggtctggcacacctggcagaagcagacacaacgatctggagtgctttgggatgttccgtcccctcccgaaactcagaaagctgagctggaagagggtgtataccgcatcaagcagcagggcattttcgggaaaacccaagtgggagtcggcgtgcagaaggagggtgtttttcatacgatgtggcacgtgacacggggggccgtcttgacttataacggaaagagactagaaccaaattgggcaagcgtgaaaaaggacctgatatcgtacggcggcgggtggaggctctcagctcagtggcaaaaaggagaggaagtacaggtcatcgccgtggagcccggtaagaaccctaaaaatttccagaccatgccaggcacattccagaccactaccggggaaattggagcgatcgccctggattttaagcccggcacatctggtagtcctattatcaaccgtgaggggaaggttgtgggactttatggcaatggcgtcgtgacgaaaaacgggggatacgtttccggtatagcacaaactaatgctgagccggacggcccaacccccgaattagaggaagagatgttcaagaaacgcaacctgacaatcatggatctccaccctgggagcggaaagacccggaaatatttgccagccattgtgagagaagctatcaagaggcgactgcggactctcattctggcacccacacgcgtcgtggccgccgagatggaggaagctcttaagggcctgcctatcagataccagaccacggcgactaaatctgagcatacaggtagggaaatagtagacttgatgtgccacgcaacctttaccatgcggctactgagcccggtgcgagttcccaattataacctcattatcatggatgaggcccatttcactgacccagcttccatcgccgcaagagggtacatttcaacacgcgtcggaatgggcgaagccgctgcgatctttatgaccgccacacctcccggcactgcagatgctttcccacagagtaatgcccctatacaggacgaggagagggacattcccgaacgtagctggaactctgggaatgagtggatcacggattttgcaggaaagaccgtgtggttcgtgccatccattaaagccggtaacgacatcgctaactgtttacggaagaatggcaaaaaggtcatacaactgtcaagaaagacatttgatactgaataccagaaaaccaagcttaacgactgggatttcgtagtgacaaccgacattagtgagatgggggccaattttaaagcggatagggttatcgacccgcgccgatgcctgaagcctgtgatcctcactgatggacccgagagagtcattttggcaggcccaatgcccgtgacggccgctagcgccgctcagcggaggggtcgcgttgggcgtaaccctcagaaagaaaatgaccaatatatcttcaccggccagccactgaacaatgatgaggaccacgcacattggacagaagccaagatgctcctggacaacattaatactcccgagggaataatccctgctcttttcgaaccggagagagagaagtccgccgcaattgatggcgaataccggctaaaaggggagtctaggaagacctttgtggaactgatgcgccgaggagacttgccagtctggttagcgcacaaagtggcctcggagggtatcaagtatacagatagaaaatggtgcttcgacggccagcggaacaatcagatcctggaagagaacatggatgtagagatttggaccaaggaaggggagaaaaagaagctcaggccccgctggctggacgctagaacttacagcgatcctcttgccctgaaagaatttaaggacttcgcagctggaaggaaatcaatagccctcgatttggtgacagagatcggccgggttccctcccacctggcacatcgtacgcgcaatgccctagacaacctggtcatgctccacaccagtgaacatggtgggcgagcttatagacacgcggtggaggagcttccagaaactatggagacactgttattgctgggcctcatgattctgcttaccggaggcgccatgctgtttctcatctctgggaagggaattggtaaaaccagcatcggcttgatatgtgtgatcgcatcctcagggatgtcttggatggctgaaattcctctgcaatggatcgccagcgccattgtcttagagttctttatgatggttctactgatccccgagccagaaaagcagaggacacctcaggataatcaactcgcatacgtggtaataggaattcttactctggctgccatcattgcggctaacgagatgggcttgctggaaacgaccaagcgggacctcggtatgagtaaagagccgggggtggtctcccccacaagctatctggatgtggaccttcacccagcctctgcatggactctctacgccgttgctaccacagtgatcacccctatgctgcgccatactatagaaaattcaacggcaaacgtctccttggccgcgatcgctaaccaggccgtagtgctgatgggcttagacaagggatggcccattagtaaaatggatctaggcgttccactgctcgcacttgggtgctacagccaggtgaatcctctgacattgaccgccgctgtcctgctcctgatcactcactatgccattatcggacccggccttcaggcaaaggctaccagagaggcccaaaaaaggacagcggccggtataatgaagaacccgactgtggacgggattatgaccatcgatttagacccagtcatctacgattcgaagttcgagaaacagctgggacaggtgatgctcttggttctgtgtgcagtgcagctactgctcatgcggacatcttgggctctttgcgaagccctgacgttggcaaccggccctattactacactgtgggagggttcccccggcaagttttggaataccactatcgctgtaagcatggccaacatattccgagggtcatatctcgccggagtgggcctggcgtttagtattatgaaatctgtcgggacaggaaagagaggcaccggttcccaaggggaaacgttaggagagaaatggaagaagaaacttaatcagctgagccgcaaggaattcgacctctacaaaaagtcaggcatcaccgaggttgataggacagaggctaaagaaggtctaaagcggggcgagattactcatcacgcagtgagtcgtgggagcgccaaactgcagtggtttgtcgaaagaaacatggtgatcccagagggaagggtaatagacttgggctgtgggcgcggaggctggtcctattactgcgctggtctgaagaaggtgaccgaagttcgggggtatacaaaaggaggccccggccatgaggagcctgtgccgatgtctacttacgggtggaatatcgtcaagctcatgagcggaaaagatgtgttctaccttcccccagaaaagtgtgacaccctgttgtgcgatattggtgagtcctcaccttctcccacagtcgaagagagtcgaaccatcagagtgctgaaaatggttgagccttggctcaagaacaatcagttctgtattaaggtattaaacccatatatgcccactgtgatcgaacacctggagaggcttcaacgcaaacacggcgggatgctggtccggaatcctctatcgagaaacagcacgcatgaaatgtactggatttccaatggaacaggcaacatcgtggcctctgttaatatggtgtcacgtctcctgttgaacaggtttaccatgactcaccggcgcccaaccatagagaaggacgtcgatctgggtgcagggacacgacatgtgaacgccgaacccgagacgccgaatatggacgtaattggagagagaatcaaaaggatcaaggaagagcacaacagcacctggcactatgacgatgaaaatccttacaaaacttgggcttatcatggctcctacgaggtgaaggcgacaggcagtgcctctagcatgattaacggggttgtcaagctccttaccaaaccatgggacgtggtgcccatggtcactcagatggcaatgacagataccacacctttcggacagcaacgggtttttaaggaaaaagtggacactcgcaccccaagatcaatgcccggtacgaggcgagtaatgggcataaccgctgagtggctgtggcggacattagggcgtaataagaaaccgagactgtgcactcgcgaggaattcaccaagaaggtgaggacaaacgccgcaatgggagccgtctttactgaggaaaatcagtgggattccgctaaagccgcggtggaggacgaagatttctggaagttggttgaccgggagagagagctccacaaactgggcaagtgtggtagttgcgtgtataacatgatggggaaacgcgaaaagaaactaggagagtttggcaaggcaaagggcagcagggccatctggtacatgtggcttggggctcgatacctggaattcgaggccctcggatttctgaatgaggatcattggttctctcgggaaaactcctattcaggtgtcgagggcgaagggttgcacaaactgggatacattctcagagacatcagcaagattcctggcggtgcaatgtatgctgatgacaccgccgggtgggacacgaggatcacagaggatgaccttcataatgaagagaaaataacccagcagatggatcccgagcaccgccaactggctaacgccatctttaagttaacttaccagaataaagtggtaaaggttcagcgtccaacacctaccggaactgtgatggacattatctcgcggaaggatcagagaggctctggccaagtcgggacctatggactgaacacattcacgaatatggaagcacagttgattaggcagatggagggtgaaggcgtgctcagtaaagcggacctggagaacccccacctaccagaaaagaaaatcacccagtggcttgagactaagggggtggagcgcctgaaacgaatggccatatccggagatgactgcgtcgttaagcccattgatgaccggtttgctaacgccctcctggcattgaatgatacaggcaaggtgagaaaagacatccctcaatggcagccaagcaagggttggcatgattggcagcaggtaccgttctgttcacaccatttccacgaattaatcatgaaagacgggaggaagctggtggtcccctgccgccctcaagacgagctcattggaagagctcggatatcccagggcgccggctggtctcttagggaaaccgcatgtctggggaaagcctacgcgcagatgtggagcctaatgtattttcaccgtcgagatctgcgcctcgctagtaacgccatctgctccgcagtgccagttcattgggtgcccactagcagaacaacctggtctattcacgcccatcaccaatggatgacgacagaggacatgttgaccgtctggaatcgggtgtggatcgaagataacccttggatggaggacaagactccagtaaccacatgggagaatgttccctacctgggaaagagggaagatcagtggtgtggttcacttattggcctgactagtcgcgctacctgggcccagaacatccctacagcaatacagcaagtgagatccctcatcgggaatgaggaattcttagactacatgccgagcatgaaacggtttaggaaggaggaggaatctgagggagctatttggtga

SEQ ID NO: 15667 - RNA, 9873 nt, synthetic construct
  misc_feature 1..9873: note = derived and/or modified CDS sequence (opt3) from DENV-3__DQ675519__SS-prME
  source 1..9873: mol_type = other RNA
accagcatctgcctgatgatgatgctccccgccacccttgctttccacctgacttccagggacggcgaacctaggatgattgtggggaagaacgaacggggaaaatctttgttatttaagacggcctcaggtataaatatgtgtaccctgatcgccatggatttaggcgagatgtgcgacgatacagtcacttacaaatgtccactcattaccgaagttgagccggaagacatcgattgctggtgtaacctgacaagtacctgggtgacttatgggacatgcaatcaggcgggagagcatcgccgagacaagcgtagcgtagctcttgcaccccacgtgggcatgggtctggataccagaacgcagacttggatgtccgcagagggggcctggaggcaggtcgaaaaagtggagacctgggctttccggcatcctggatttacaattttggcactcttcctggcccactacatcggcacttctctgacccagaaggttgtgatatttatcctcttaatgctggtcacaccatcgatgaccatgcgctgtgtgggcgtagggaacagagacttcgttgaaggactttcaggtgctacgtgggtggatgtcgtgttggagcatggcgggtgcgtgactacaatggccaagaataaacccaccctggacattgagcttcagaagactgaagcgacacaactcgcaaccctgaggaaactttgtatcgagggaaagattacgaacgtcaccacagatagccggtgccctactcagggcgaagccatcctgccagaggaacaggaccagaattatgtttgtaaacacacctacgtggatcgcggttgggggaacggatgcggcttgtttggcaaggggagtctcgtaacatgcgctaagttccaatgtctggagtccatagagggaaaagtggtccagcacgaaaatttaaagtatactgtgattatcaccgttcatacaggtgaccagcaccaggtgggcaacgagacccaaggggtcactgccgaaattacgccccaggcatctacagtggaggctatcctgcctgaatacggaaccctcggccttgagtgcagcccacgaactggtctggactttaatgagatgatcttgctaaccatgaaaaacaaggcctggatggtacatagacagtggttctttgatctgccgctcccctggacatccggggcgaccactgaaacacctacgtggaataaaaaggagctgcttgttaccttcaaaaacgcccacgcaaagaagcaagaagtggtcgtgctgggctcacaggagggagctatgcacactgccttgacaggcgctaccgaaattcagacaagtgggggaactagcatatttgccggtcatctcaaatgtaggctgaagatggacaaattagagctgaagggcatgtcttatgcaatgtgcctaaatgccttcgtcctcaaaaaggaggtgtccgaaacccagcacgggacgatcctgattaaggttgagtacaaaggagaagatgctccatgtcggatccccttctcaaccgaggacggccaaggtaaggcgcataacgggcgtcttataacagcaaaccctgtggtaactaaaaaggaggaaccagtcaatattgaggccgaacccccgtttggcgagagcaacatcgtgatcggaattggcgataaggctttgaagatcaattggtacaagaaagggagttctattggaaagatgttcgaagccaccgcacgcggtgccagaaggatggctatactgggcgacacagcctgggattttgggtccgttggaggcgtgctcaacagcctgggtaaaatggtccaccagatcttcgggtcggcatatactgcgctattttctggcgtgtcctggattatgaagatcggaatcggcgtactgttgacctggattgggctcaatagcaagaacacgagtatgagcttctcctgcatagtgatcggaattatcacactgtacttaggcgctgttgtccaggccgacatgggttgtgtgattaattggaaggggaaggagctgaaatgcggaaacggcatctttgtgaccaatgaggtccatacttggacagaacagtataagttccaagcagattctcctaaacggctagccaccgctatagccggtgcatgggagaacggcgtttgtgggatccgaagcactacccgcatggaaaatctcctgtggaagcagattgctaacgagcttaattacatcttgtgggaaaacaatattaaactgacagtggtggtaggagacatcataggcgtcctcgagcaggggaagagaacgctgacaccccagccaatggagttaaaatattcatggaagacttggggaaaggccaaaattgtgacagcggaaacccaaaacagttcctttatcattgatggccctaacacacccgagtgcccaagcgcctctagggcttggaatgtttgggaagtggaggactacggtttcggggtctttactaccaacatctggctgaaacttcgggaagtgtatacgcagttgtgtgaccaccgcctcatgtcagcagccgttaaagatgagagagctgtgcacgccgacatgggatactggatagagagtcagaagaatggcagctggaaactggaaaaggcatccctaatcgaggtaaagacatgcacctggcccaaatctcatactctgtggtcgaacggtgtcctcgaaagcgatatgattatccctaagtccctggcgggcccaatttcacagcacaatcataggccggggtaccacacccaaacagccggaccctggcaccttggcaaattggagctggacttcaactattgcgaggggactaccgtggtgatcacagaaaattgtggaacgcgtggccctagtttacggaccactacagtctctggtaagctcatacatgagtggtgctgtcgaagctgcaccctgccaccccttagatacatgggggaagatggatgttggtatggcatggagattaggcctatcaacgaaaaagaggagaatatggttaagtccctggtgtcagctggtagcggcaaggtagacaactttactatgggggtgttgtgcctcgccatcctgttcgaagaggtcatgcgcggaaaattcggcaagaaacacatgattgcaggggtgctatttacattcgttctgctcctgtctggacagatcacctggcgggatatggctcatacgcttattatgataggctccaatgccagtgacagaatgggtatgggggtgacttacttggcactgatcgccacctttaagattcagccattcttagctctcggatttttcctgaggaaacttacaagccgcgaaaacctgctactcggcgtcggcctggcgatggccaccactttgcaactgcccgaggatatcgaacagatggcaaatggggtggctttaggactcatggccctgaaacttattacacagtttgagacctatcagctgtggacagccttggtttctctcatgtgttccaacactatcttcaccctgacggtggcttggcgaacagcaaccctaatactggccggtatctcacttctcccggtctgccaaagtagctcgatgcggaagactgactggctgcctatgaccgtagcggctatgggcgtgccacccttgcctctgtttattttctccttaaaagatacactcaagcgtagatcttggcccctgaatgagggggttatggccatcggacttgtgagcattctggcatcaagtttgctcaggaacgacgtcccaatggccggccctctggtggctggtgggctactgatcgcatgttacgtaataactggaacctccgccgatcttacggtggaaaaagcggctgacgtcacatgggaggaagaggccgaacagaccggcgtttctcacaacctcatgattactgtggacgatgacggcacaatgcgcatcaaggatgacgagaccgagaatatcctgactgtgttgttaaaaacagcactgctcattgtcagcgggatatttccctattccatcccagccaccctgcttgtgtggcatacgtggcagaagcagactcaacggtcaggagttctgtgggatgtaccgagccctcccgaaacccagaaagctgagttggaagagggtgtgtacagaattaagcagcagggcatcttcgggaagacacaagtcggagtgggcattcagaaagagggtgtttttcacaccatgtggcacgtgacaagaggggccgtcctaactcataacggaaagcgactggaaccaaattgggcaagtgtgaaaaaggacctcatctcttacggcggcgggtggcgcctgtccgctcagtggcaaaaaggagaggaagtacaggtcatagccgtggagcccggtaagaaccctaagaatttccagaccatgccaggcatcttccagacgacaactggggaaattggagcgatcgcccttgattttaaacccggcaccagcggttcgcctattatcaaccgggaggggaaggttgtgggattatatggcaatggcgtcgtgactaagaacgggggatacgtttcaggtatagcacaaaccaatgctgagccggacggcccaactcccgaactggaggaagagatgttcaagaaaagaaacctcaccattatggatttgcaccctgggtctggaaagacaaggaagtatctgccaacgatcgtgcgtgaagccatcaaacgccggctcagaactctgattcttgctcccaccagggtcgtggcagccgagatggaggaagccctgaagggcttgcctatccgataccagacaaccgctactaaaagtgagcatacaggtaaggaaatagtagacctaatgtgccacgcgacctttacgatgcggctgctctccccggtgcgcgttcccaattataacttaattatcatggatgaggcacatttcactgacccagccagcattgctgccagagggtacatctctacaagggtcggaatgggcgaagcagccgctatatttatgaccgcgacccctcccggcactgccgatgcattcccacagagcaatgctcctattcaggacgaggagcgggacatccccgaacgatcctggaactcagggaatgagtggatcacagattttgtgggaaaaaccgtgtggttcgtcccaagtattaaggccggtaacgacatcgcaaactgtctgagaaagaatggcaaaaaggtaattcaacttagccgcaaaacatttgatactgaatatcagaagacgaaactgaacgactgggatttcgtggttaccacagacatatctgagatgggggccaattttaaggctgatagggtgatcgacccgcgtcggtgcctcaagcctgtcattttgactgatggacccgagagagtgatcctggccggcccaatgcccgttaccgtggcgtccgcagcccagaggcgcggtcgagtcgggagaaaccctcagaaagaaaatgaccaatacatcttcacaggccagccactcaacaatgatgaggaccacgctcactggaccgaagccaagatgctgcttgacaacattaatactcccgagggaataatccctgctctattcgaaccggagcgggagaaatcagcagccattgatggcgaatacaggctgaagggggagagtcgcaaaacgtttgtggaattgatgcgtagaggagacttaccagtatggctggctcataaggtggccagcgagggtatcaaatataccgatcggaagtggtgcttcgacggcgaaaggaacaatcagattctcgaggagaacatggatgttgaaatctggacaaaggagggggagaagaagaaactgcgcccccgatggcttgacgcaagaacttactccgatcctctggcgctcaaggagtttaaagacttcgccgctggacggaagtctatagccttggatctggtcaccgaaatcggcagggtgccctcgcacctagcatatcgcacaagaagcgctctggacaatctcgtgatgcttcatacctcagagcacggtgggagggcctaccggcacgcagtcgaggaactgccagagactatggaaacattattgctgctcggcctgatgattcttctgacgggaggcgccatgctctttttgatctccgggaagggaattggtaaaaccagtatcggcctgatatgtgttgtggcttctagcgggatgttatggatggcggatgtacctctacagtggattgcctccgcaatcgtgctggagttctttatgatggtcctccttattcccgagccagaaaagcaacgtactcctcaggacaaccagctggcttatgtggttatcggaatattgacactggccgccatcgtggcagctaatgagatgggcctcctggaaaccaccaaacgcgatcttggtatgtcaaaggagccgggggtcgtatctcccacaagctacctcgacgtggacctgcatccagccagtgcgtggactttgtatgctgttgccacgaccgtgattacacctatgctgcgacacactatcgaaaactccaccgcaaatgtcagcttagccgctattgcaaaccaagccgtggtcctaatgggcctggataaaggatggcccatctctaagatggacctcggcgtgccacttctggcgttggggtgctactcacaggttaaccctctgacactcaccgctgccgtgctgcttttagtaactcattacgcaataattggacccggcctgcaggccaaggctacgagagaggcccagaaaaggacagcagctggtatcatgaagaatccgaccgtggatgggatcatgactattgacctcgatccagtcatctatgactccaaattcgagaagcaattgggacaggttatgctgctagtgctgtgtgccgtccagctccttctgatgcggaccagttgggcgttttgcgaagccttgacactggcaactggccctataaccacactctgggagggtagccccggcaaattctggaacacgaccattgctgtgtcgatggccaatatctttcgcgggtcttacctggcaggagctggcttagccttctccattatgaagtcagtagggactggaaagagaggcacaggttcacagggggaaacccttggagagaaatggaagaaaaagctgaaccaactcagtaggaaagaatttgatctatataagaaatctggcatcactgaggtggaccggacaaaggccaaggagggtctgaaacgaggcgaaaccacgcaccatgcggtttccagagggagcgctaagttgcagtggttcgtggagcgcaatatggtcataccagaaggaagggtgatcgatctgggctgtgggcggggaggctggtcatactattgcgcaggtctcaaaaaggtcaccgaggtgcgtgggtacacaaaaggaggccccggccacgaagaacctgttccgatgagtacttatgggtggaacattgtaaaacttatgagcggaaaggacgtgttctacctgcccccagagaaatgtgataccttgctgtgcgacatcggtgaatcctctcctagccccacagtcgaggaatccagaactattagggtgctcaagatggttgagccttggctgaaaaataaccagttttgtatcaaggtgctaaatccatacatgcccaccgtcattgagcaccttgaacgcctgcagcggaaacatggcgggatgctagtgcgaaaccctctctcaagaaattctacacacgagatgtattggatcagtaacggaaccggcaatatagtatcgagcgtgaacatggtttccaggctgttgctgaatcgcttcactatgacgcatcggagaccaacaattgaaaaggatgtcgacctcggtgccgggacccgtcacgtgaacgctgagcccgaaactccgaacatggacgtgatcggagagaggatccggcgcattaaggaggaacactcttcaacctggcattacgatgacgagaatccttataaaacatgggcctaccacggcagctatgaagtcaaggcaacgggctccgccagttctatgataaacggggttgtgaaacttctgaccaagccatgggatgtagtgcccactgtcacacaaatggctatgaccgacactacaccttttggacagcagcgagtgttcaaagagaaggttgataccagaacaccaaggcccatgccgggtactcggaaggtgatggaaatcaccgcggagtggttatggcgcacgctgggcagaaataaaaggcctcgattgtgcacccgggaggaatttacaaagaaagtccgtactaacgccgcaatgggggctgtgttcaccgaggaaaatcaatgggacagcgccagagcagccgtagaggatgaagagttttggaagctcgttgaccgcgagagggaactgcataaactaggaaagtgtggctcatgcgtgtacaacatgatgggtaaacgggagaagaaacttggggagttcggaaaagctaagggctccagagccatttggtatatgtggctgggcgcgcgctacctcgagtttgaggcactggggttcttgaatgaagatcactggtttagtagggagaacagctactctggagtcgaaggtgagggcctgcataaactcgggtatatccttcgagacatttccaagacacccggaggcgccatgtacgctgatgacactgccggttgggacacccggatcacggaagatgacctgcacaatgaggagaaaataacacagcagatggatccagaacacagacagttagcaaacgctatcttcaagctgacctatcaaaataaggtggtgaaagtccagaggcctactcccaaggggacagttatggacattatctcacgcaaagatcagcgtggaagcggccaggtgggcacctacgggttgaacacttttaccaatatggaggcccaactcattcggcagatggaaggagagggtgtactgtcgaaggctgacctagaaaacccacatcttcccgagaaaaagatcacacagtggctggagacgaagggcgtggaaagactcaaaaggatggccatatctggggatgactgcgtcgtgaagcctattgatgaccgcttcgcaaatgcgctgttggccttaaacgatatgggaaaagttcgaaaggacatcccacagtggcaaccgagtaaaggctggcacgattggcaacaggtgcccttctgttcccatcactttcacgagctgatcatgaaggacggtcggaagctcgtcgtgccttgcagaccacaggacgaacttattgggagggctcgcataagccaaggagccggctggtcactgaaagagaccgcatgtctaggcaaggcttatgcccagatgtggtccctgatgtacttccatagacgggatctcaggttggcatctaacgccatctgcagcgcggtacccgttcactgggtgcctacaagtcgtacaacctggtccattcatgctcaccatcagtggatgactacagaagacatgctgaccgtctggaatcgagtgtggatcgaggataacccatggatggaggacaaaacgcccgttacaacctgggaagatgtgccttatcttgggaagcgcgaggaccaatggtgtggaagcctgattggtctcacttctagagccacctgggcacagaatatcttaacagccatacagcaggtccggtcactgatcggcaacgaagagtttttggattacatgccgagtatgaaaaggttccgcaaggaggaagagtccgaaggggctatttggtga

SEQ ID NO: 15668 - RNA, 9873 nt, synthetic construct
  misc_feature 1..9873: note = derived and/or modified CDS sequence (opt3) from DENV-3__DQ675521__SS-prME
  source 1..9873: mol_type = other RNA
accagcttctgcctgatgatgatgctccccgccacacttgcttttcacctgacttccagagacggcgagcctaggatgatcgtggggaagaacgaacggggaaaatctttgttattcaagacggcatcaggtattaatatgtgtaccctgatagccatggatctaggcgagatgtgcgacgatacagtcacttacaaatgtccactcatcgcggaagttgagccggaagacattgattgctggtgtaacctgaccagtacatgggtgacctatgggacttgcaatcaggctggagagcatcgccgagacaagcgtagcgtagcccttgcaccccacgtgggcatgggtctggatacaagaacccaaacgtggatgtccgccgagggggcttggaggcaggtcgaaaaagtggagacttgggcattgcggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacattacgaccgatagccggtgccctacacagggcgaagctatcttgccagaggaacaggaccagaattatgtctgtaaacacacttacgttgatcgcggttgggggaacggatgcggcctctttggcaaggggagtctggtgacctgcgccaagttccaatgtttagagcccatagagggaaaagtagtgcagtatgaaaatctgaagtacacagtcattatcactgtgcacaccggtgaccagcatcaggttggcaacgacacacaaggggtgaccgtcgagattactcctcaggcatccacggtggaagctgtactcccagagtatggaacacttggcctggaatgctctccgcgaaccggtttggattttaatgagatgatcctactgactatgaaaaacaaggcctggatggttcacagacagtggttctttgacctccccctgccttggaccagcggggcgacaaccgagactccaacatggaataggaaagaacttctggtgacgttcaagaacgcccatgcaaaaaagcaagaggtcgtggtcttgggctcccaggaaggagctatgcacaccgccctcactggcgctacagagatccagaattcagggggaaccagtatttttgccggtcacctgaagtgtcggttaaaaatggataagctggaactaaaaggcatgagctacgcaatgtgcctcaacacattcgtgctgaagaaagaggtttctgagactcagcatgggaccatacttatcaaggtggaatacaagggagaggacgccccctgtaaaattcctttctccacggaagatggccaaggtaaggctcacaacgggcgtttgatcaccgcgaatccagtagtcacaaaaaaggaggagcccgtgaacatagaagcagagccgccttttggcgaatcaaatattgttatcggaatcggcgacaaagccctgaagattaactggtataagaaagggagcagtatcggaaagatgttcgaggctactgcccgcggtgcaagaaggatggccattctcggcgataccgcttgggactttgggtctgtgggaggcgtcctgaattcccttggtaaaatggtgcatcagatattcgggagcgcctacacagcactgttttcgggcgtatcttggatcatgaagattggaatcggcgtgttgctcacttggatcgggctgaactccaaaaatacctcaatgagtttcagctgcattgttataggaatcattacgttatatctgggcgcggtcgtgcaggctgatatgggttgtgtgatcaactggaaggggaaggaactaaaatgcggatccggcatttttgtcacaaatgaggttcacacctggactgagcagtacaagttccaagccgactctcccaaacggctcgcaacagccatcgctggtgcctgggaaaacggcgtgtgtgggatacgaagcaccactcgcatggagaatctgctttggaagcagatcgcaaacgaattgaattatattctgtgggagaacaatatcaaactcaccgtggtagtcggagatattatcggcgtgctggaacaggggaagagaacattaacgccacagcctatggagctgaaatactcatggaagacctggggaaaggctaaaatagttactgccgagattcaaaacagttcctttatcattgacggccccaacacaccagaatgccccagcgcgtctagggcctggaatgtgtgggaggtcgaagactatggtttcggggtgtttaccacaaacatctggcttaagttgcgggagatgtacactcagtcatgtgatcatcgcctcatgagtgctgcaataaaagacgaaagagccgttcacgctgatatgggatactggatcgagagccagaagaatggctcctggaaactggagaaggcctctttcattgaagtgaagacctgcacgtggcctaaatcgcacacactatggagcaacggtgtactggagtccgacatgatcattccaaagtcactcgcaggcccgatcagtcagcataatcacaggcccgggtatcatacccaaactgcgggaccttggcacctgggcaaacttgaattggattttaactactgcgaggggaccacagtcgtgataactgagaattgtggaacccgtggcccatctctgcggacaacgaccgtgagcggtaagttaattcacgaatggtgctgtcgatcctgcactctcccccctctgagatatatgggggaggacggatgttggtacggcatggaaatcaggccaatcaacgagaaagaagagaatatggtcaagtcacttgttagcgccggttctggcaaggtggataacttcacaatgggggtactgtgcttggctattctcttcgaggaagtgatgcgcggaaaatttggcaagaaacatatgatcgtcggggtgctgttcacctttgttctactgctctccggacagattacttggcgggacatggcccacacactgataatgatcggcagtaatgcaagcgatagaatgggtatgggggtgacctatcttgctttgattgccacgttcaagatccagccctttctggcattaggattctttctcaggaaactgacttctcgcgagaaccttctgctaggcgtcggcctcgccatggctaccacactgcaattgccggaagacattgagcagatggcgaatgggatcgccctgggattaatgaccctcaagctgataactcagttcgaaacataccagctttggaccgcactggtgtccttgacatgttcaaacactatctttaccctcacggttgcttggcgaacagccaccctgattctagccggtgtgagtctgcttcctctctgccaaagctcgtccatgcggaagactgattggctgccaatgaccgtcgctgcaatgggcgtaccccctttgcccctgttcatcttttctttaaaagacacaccaaagcgtagaagctggcctctcaatgagggggtgatggccgttggactggtgtcaattcttgcgagttccctgttgaggaacgatgtccccatggctggcccactcgtggccggtgggctgctaatcgcatgttatgtaataactggaacctctgccgacctgacggtggagaaagctgcagacgtcacatgggaagaggaagccgagcagaccggcgttagccataaccttatgattactgtggatgacgatggcacaatgcgcatcaaggacgatgaaaccgagaatatcctcactgtgctgttgaaaacagcgttactgattgtctccgggatattcccgtactcaatccctgctaccctcctggtgtggcacacgtggcagaagcagactcaacggagcggagttctttgggacgtacccagtccacccgagacccagaaagccgaactggaggaaggtgtgtacagaattaagcagcagggcatctttgggaagacacaagtcggagtgggcgttcagaaagagggtgtgttccataccatgtggcacgtcacaaggggggcagtgttgactcacaacggaaagcgactagagcctaattgggcctctgtaaaaaaggatctgatttcctatggcggcgggtggcgcctcagcgctcagtggcaaaaaggagaagaggtccaggtgatcgccgttgaaccaggtaagaaccccaagaatttccagaccatgcctggcatatttcagacgacaactggggagatcggagcaattgctctggacttcaaaccgggcacctcgggttcaccaatcattaaccgggaagggaaggtggtcggactttacggcaatggcgtggttacaaaaaacgggggatatgtgtctggtatcgcccaaaccaatgcggagcccgatggccctactccagagttagaagaggaaatgtttaagaaaagaaacctgaccataatggacctccatcccgggagtggaaagacaaggaagtacttgcctgccattgtccgtgaggcaatcaaacgccggctgagaacgctcatcctggctccgactagggtggtagccgctgaaatggaggaggcacttaagggcctgcccattcgatatcagaccacagccaccaaatccgaacacactggtcgggagatcgtggatttgatgtgccatgccacattcaccatgcgcctactgagcccagttagagtccctaattacaacctcataattatggacgaagctcactttacggatcccgcgtctatcgcagccagggggtatattagcactcgggtgggaatgggcgaggctgccgcaatcttcatgacagccaccccacctggcaccgctgaagcgtttccccagtccaatgccccaatacaggacgaggagcgagacattccggaaagatcatggaacagtgggaatgagtggatcactgatttcgtgggaaagacagtctggtttgtacctagcatcaaagcaggtaacgacattgctaactgtttacgcaagaatggcaagaaagtgatccaactgtctaggaagaccttcgatacagaataccagaaaactcgtcttaacgactgggattttgttgtgacgaccgacatttccgagatgggggccaatttccgggcagatagagtcatagaccccaggcgctgcctgaagccagtgatcctcacagatggacccgagcgagttattttggccggccctatgccagtgactgctgcctcagcggcacagagacggggtagggtcgggcgcaacccccagaaagaaaatgaccaatacatcttcaccggccagcctctgaacaatgatgaggaccatgcccactggacagaagctaagatgctcctggacaacatcaataccccggagggaattataccagccctttttgaacccgagcgtgagaagagtgctgcaatcgatggcgaatatagactaaaaggggagagccggaagactttcgtggaactgatgaggcgcggagacttgcctgtatggttagcccacaaagtggcttccgagggtattaagtacacggatcgaaaatggtgctttgacggcgaaagaaacaatcagatcctggaggagaacatggatgttgaaatttggaccaaggagggggaacggaaaaagctcaggccccgctggctggacgccagaacatattctgatccacttgcactgaaggagttcaaagactttgcggccggaaggaagtcgatcgctctcgatttggtcactgaaataggccgggtgcctagccatctggcccaccgtacccgcaatgcactagacaacctggtgatgctccatacatcagagcacggtgggcgagcttacagacacgccgtcgaggaacttcccgagaccatggaaactctgttattgctgggcctcatgatcctgcttacaggaggcgcaatgctgttcctcatttccgggaaaggaatcggtaagacgagtattggcttgatctgtgttatagtgtctagcgggatgctgtggatggccgatgtaccattacagtggattgcttccgcgatcgtgctagagtttttcatgatggtcctgctcattcctgagccggaaaaacaaaggaccccccaggacaatcagcttgcctatgtggttatcggaatactgactttggcagctatcgtggccgccaacgagatgggcctgctcgaaacaaccaagcgggatctgggtatgtcaaaggagccaggggtcgtatctcctaccagctaccttgacgtggacctccatcccgcaagtgcttggacactgtatgccgttgcgactacggtgattaccccaatgttgcgccacacaatcgaaaattccactgctaacgtcagcctggccgcaattgccaaccaagctgtggtcttaatgggcctagataaaggatggcctatctctaagatggacctgggcgtgcccctccttgcactggggtgctactcacaggttaatccgttgaccctgacagccgcggtgctcctgcttgtaacccattacgctataattggaccaggcttacaggccaaagcaactagagaggcccagaagaggacggctgccggtatcatgaaaaaccctacagtggatgggatcatgaccattgacctggatcccgtcatctatgactccaagtttgagaagcaactcggacaggttatgttgctggtgctatgtgcagtccagctgctccttatgcggactagttgggctctgtgcgaagccttgaccctggcgacaggcccaataactaccctctgggagggtagccccggcaaattctggaatacaacgattgccgtgtcgatggcaaacatctttcgagggtcttacctggctggagccggcttagcattctccattatgaagagcgtagggaccggaagacgcggcactggttcacagggggaaacacttggagagaaatggaagaaaaagctgaatcaactcagtaggaaggaatttgatctatataaaaagtctggcatcaccgaggtggaccggactgaggctaaagaaggtctgaagcgtggcgagacaacccaccatgccgtttccagagggagcgccaaattgcagtggttcgtggaaaggaacatggtcatacctgagggacgcgtgatcgatctgggctgtgggcggggaggctggtcatactattgcgcgggtctcaagaaagtcacggaagtgcgagggtacaccaagggaggcccgggccacgaggagcccgttccaatgagtacatatgggtggaatattgtaaagcttatgagcggaaaagacgtgttctacctgcctcccgaaaagtgtgatactttgctgtgcgacatcggtgagtcctctcctagcccaaccgtcgaagagtccagaacaattagggtgctcaaaatggttgagccctggttaaagaacaatcagttttgtatcaaagtgctgaacccttacatgccaactgtcattgaacaccttgagcgcctgcagcggaagtatggcgggatgctagtgagaaatcccctctcacgtaactctacccatgaaatgtactggatcagtaatggaacaggcaacatagtatcgagcgtgaatatggtttccaggctgttgctgaaccggttcaccatgactcaccgccgaccgacgattgagaaggatgtcgacctcggtgctgggacaagacatgtgaacgcagaacctgagaccccaaatatggacgtgatcggagagaggatcaaacggattaaggaagagcactcttcaacttggcactatgatgacgaaaacccctacaaaacctgggcctatcatggcagctacgaggtcaaggctacaggctccgccagttctatgataaatggggttgtgaaacttctgacgaagccttgggatgtagtgccaatggtcacccaaatggcaatgactgacacaaccccctttggacagcagcgcgtgttcaaggaaaaagttgatactagaacaccgaggcctatgcccggtacccgaaaggtgatggagatcacagccgagtggttatggcggactctgggccgtaacaaaaagccaagattgtgcacccgcgaagagtttacgaaaaaggtcaggaccaatgctgcgatgggggccgtgttcacagaagagaaccaatgggacagcgcacgggctgccgtagaagatgaggagttttggaagctcgttgacagagaacgcgagctgcacaaactaggaaagtgtggctcatgcgtgtataatatgatgggtaaaagggaaaagaaacttggggagttcggaaaggcaaaaggctcccgagccatttggtacatgtggctgggcgctcggtacctcgagtttgaagccctggggttcttgaacgaggatcattggtttagtagagaaaatagctattctggagtcgagggtgaaggcctgcacaagctcgggtacatccttagggacatttccaagatccctggaggcgcgatgtatgcagatgacactgccggttgggacacccgcataacagaggatgacctgcataacgaggaaaaaatcactcagcagatggatcccgagcaccgtcagttagcttcagccattttcaagctgacctaccaaaataaagtggtgaaggtccagcggccaacgcccaaagggacagttatggacatcattagcagaaaggatcagaggggatcgggccaggtgggcacctatgggttgaacacttttacaaatatggaagcacaactcgtacgccagatggagggagaaggtgtgctgtctaaggctgacctagagaaccctcaccttctggagaaaaagatcacccagtggctcgaaactaaaggcgtcgagcgactgaagcggatggccataagtggggatgactgcgtggttaaaccaattgatgacagattcgctaatgccttgttagcactgaacgatatgggaaaggtgaggaaggacatcccgcagtggcaaccctccaaaggctggcatgattggcagcaggtccctttctgtagccaccattttcacgaactcatcatgaaggacggtcgcaaacttgtggtaccatgcagaccccaggacgagctgattgggcgggcgaggatatcacaaggagccggctggtccctaaaggaaaccgcttgtctgggcaaagcctacgcacagatgtggtctctcatgtatttccaccgtcgagatttgcgcctggctagcaacgccatctgcagtgcagttcctgtgcattgggtcccaacatccagaacgacctggagcattcacgcccatcaccagtggatgactacagaggacatgcttaccgtgtggaatcgggtttggatcgaggataacccctggatggaagacaagactcctgtgacaacctgggaggatgtcccgtacctggggaagagggaagaccaatggtgtggatctctcattggtttaacgtcacgcgcgacatgggctcagaatatcctgaccgccatacagcaggtgagaagtttgatcggcgatgaggagtttctggactacatgccatccatgaaacggttcaggaaggaagaggaaagcgagggggcaatttggtga

SEQ ID NO: 15669 - RNA, 9873 nt, synthetic construct
  misc_feature 1..9873: note = derived and/or modified CDS sequence (opt3) from DENV-3__DQ675522__SS-prME
  source 1..9873: mol_type = other RNA
accagcttctgcctgatgatgatgctccccgcaacacttgcttttcacctgacttccagggacggcgaacctaggatgatcgtggggaagaacgaacggggaaaatctttgttattcaagacggcatcaggtattaatatgtgtaccctgatagccatggatttaggcgagatgtgcgacgatacagtaacttacaaatgtccactcatcgcggaagttgagccggaagacattgattgctggtgtaacctgaccagtacatgggtgacctatgggacttgcaatcaggctggagagcatcgccgagacaagcgtagcgtagcccttgcaccccacgtgggcatgggtctggatacaagaacccagacgtggatgtccgccgagggggcttggaggcaggtcgaaaaagtggagacttgggcattgcggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactcgacatcgagctccagaagaccgaagcaactcagctggccacacttaggaaactgtgtattgagggaaagatcaccaacattacgaccgatagccggtgccctacacagggcgaagctatcttgccagaggaacaggaccagaattatgtctgtaaacacacttacgttgatcgcggttgggggaacggatgcggcctctttggcaaggggagtctggtgacctgcgccaagttccaatgtttagagcccatagagggaaaagtagtgcagtatgaaaatctgaagtacacagtcattatcactgtgcacaccggtgaccagcatcaggttggcaacgacacacaaggggtgaccgtcgagattactcctcaggcatccacggtggaagctgtactcccagagtatggaacacttggcctggaatgctctccgcgaaccggtttggattttaatgagatgatcctgctgactatgaaaaacaaggcctggatggttcacagacagtggttctttgacctccccctgccttggaccagcggggcgacaaccgagactccaacatggaataggaaagaacttctggtgacgttcaagaacgcccatgccaagaagcaagaggtcgtggtcttgggctcccaggaaggagctatgcacaccgccctcactggcgctacagagatccaaaattcagggggaaccagtatttttgccggtcacctgaagtgtcggttaaaaatggataagctggaactaaaaggcatgagctacgcaatgtgcctcaacacattcgtgctgaagaaagaggtttctgagactcagcatgggaccatacttatcaaggtggaatacaagggagaggacgccccctgtaaaattcctttctccacggaagatggccaaggtaaggctcacaacgggcgtttgatcaccgcgaatccagtagtcactaagaaggaggagcccgtgaacatagaagcagagccgccttttggcgaatcaaatattgttatcggaatcggcgacaaagccctgaagattaactggtataagaaagggagcagtatcggaaagatgttcgaggctactgcccgcggtgcaagaaggatggccattctcggcgataccgcttgggactttgggtctgtgggaggcgtcctaaattcccttggtaaaatggtgcatcagatattcgggagcgcctacacagcactgttttcgggcgtatcttggatcatgaagattggaatcggcgtgttgctcacttggatcgggctgaactccaaaaatacctcaatgagtttcagctgcattgttataggaatcattacgttatatctgggcgcggtcgtgcaggctgatatgggttgtgtgatcaactggaaggggaaggaactaaaatgcggatccggcatttttgtcacaaatgaggttcacacctggactgagcagtacaagttccaagccgactctcccaaacggctcgcaacagccatcgctggtgcctgggaaaacggcgtgtgtgggatacgaagcaccactcgcatggagaatctgctttggaagcagatcgcaaacgaattgaattatattctgtgggagaacaatatcaaactcaccgtggtagtcggagatattatcggcgtgctggaacaggggaagagaacattaacgccacagcctatggagctgaaatactcatggaagacctggggaaaggctaaaatagttactgccgagattcaaaacagttcctttatcattgacggccccaacacaccagaatgccccagcgcgtctagggcctggaatgtgtgggaggtcgaagactatggtttcggggtgtttaccacaaacatctggcttaagttgcgggagatgtacactcagtcatgtgatcatcgcctcatgagtgctgcaataaaagacgaaagagccgttcacgctgatatgggatactggatcgagagccagaagaatggctcctggaaactggagaaggcctctttcattgaagtgaagacctgcacgtggcctaaatcgcacacactatggagcaacggtgtactggagtccgacatgatcattccaaagtcactcgcaggcccgatcagtcagcataatcacaggcccgggtatcatacccaaactgcgggaccttggcacctgggcaaacttgaattggattttaactactgcgaggggaccacagtcgtgataactgagaattgtggaacccgtggcccatctctgcggacaacgaccgtgagcggtaagttaattcacgaatggtgctgtcgatcctgcactctaccccctctgagatatatgggggaggacggatgttggtacggcatggaaatcaggccaatcaacgagaaagaagagaatatggtcaagtcacttgttagcgccggttctggcaaggtggataacttcacaatgggggtactgtgcttggctattctcttcgaggaagtgatgcgcggaaaatttggcaagaaacatatgatcgtcggggtgctgttcacctttgttctactgctctccggacagattacttggcgggacatggcccacacactgataatgatcggcagtaatgcaagcgatagaatgggtatgggggtgacctatcttgctttgattgccacgttcaagatccagccctttctggcattaggattctttctcaggaaactgacttctcgcgagaaccttctgctaggcgtcggcctcgccatggctaccacactgcaattgccggaagacattgagcagatggcgaatgggatcgccctgggattaatgaccctcaagctgataactcagttcgaaacataccagctttggaccgcactggtgtccttgacatgttcaaacactatctttaccctcacggttgcttggcgaacagccaccctgattctagccggtgtgagtctgcttcctctctgccaaagctcgtccatgcggaagactgattggctgccaatgaccgtcgctgcaatgggcgtaccccctttgcccctgttcatcttttctttaaaagacacaccaaagcgtagaagctggcctctcaatgagggggtgatggccgttggactggtgtcaattcttgcgagttccctgttgaggaacgatgtccccatggctggcccactcgtggccggtgggctgctaatcgcatgttatgtaataactggaacctctgccgacctgacggtggagaaagctgcagacgtcacatgggaagaggaagccgagcagaccggcgttagccataaccttatgattactgtggatgacgatggcacaatgcgcatcaaggacgatgaaaccgagaatatcctcactgtgctgttgaaaacagcgttactgattgtctccgggatattcccgtactcaatccctgctaccctcctggtgtggcacacgtggcagaagcagactcaacggagcggagttctttgggacgtacccagtccacccgagacccagaaagccgaactggaggaaggtgtgtacagaattaagcagcagggcatctttgggaagacacaagtcggagtgggcgttcagaaagagggtgtgttccataccatgtggcacgtcacaagaggggcagtgttgactcacaacggaaagcgactagagcctaattgggcctctgtcaagaaggatctgatttcctatggcggcgggtggcgcctcagcgctcagtggcaaaaaggagaagaggtccaggtgatcgccgttgaaccaggtaagaaccccaagaatttccagaccatgcctggcatatttcagacgacaactggggagatcggagcaattgctctggacttcaaaccgggcacctcgggttcaccaatcattaaccgggaagggaaggtggtcggactttacggcaatggcgtggttaccaaaaacgggggatatgtgtctggtatcgcccaaaccaatgcggagcccgatggccctactccagagttagaagaggaaatgtttaagaaaagaaacctgaccataatggacctccatcccgggagtggaaagacaaggaagtacttgcctgccattgtccgtgaggcaatcaaacgccggctgagaacgctcatcctggctccgactagggtggtagccgctgaaatggaggaggcacttaagggcctgcccattcgatatcagaccacagccaccaaatccgaacacactggtcgggagatcgtggatttgatgtgccatgccacattcaccatgcgcctactgagcccagttagagtccctaattacaacctcataattatggacgaagctcactttacggatcccgcgtctatcgcagccagggggtatattagcactcgggtgggaatgggcgaggctgccgcaatcttcatgacagccaccccacctggcaccgctgaagcgtttccccagtccaatgccccaatacaggacgaggagcgagacattccggaaagatcatggaacagtgggaatgagtggatcactgatttcgtgggaaagacagtctggtttgtacctagcatcaaagcaggtaacgacattgctaactgtttacgcaagaatggcaagaaagtgatccaactgtctaggaagaccttcgatacagaataccagaaaactcgtcttaacgactgggattttgttgtgacgaccgacatttccgagatgggggccaatttcaaggcagatcgggtcatagaccccagaaggtgcctgaaaccagtgatcctcacagatggacccgagcgcgttattttggccggccctatgccagtgactgctgcctcagcggcacagcgaagaggtcgggtcgggaggaacccccagaaggaaaatgaccaatacatcttcaccggccagcctctgaacaatgatgaggaccatgcccactggacagaagctaagatgctcctggacaacatcaataccccggagggaattataccagccctttttgaacccgagcgcgagaaaagtgctgcaatcgatggcgaatatcgtctaaagggggagagcagaaaaactttcgtggaactgatgcggaggggagacttgcctgtatggttagcccacaaggtggcttccgagggtattaaatacacggatcgcaagtggtgctttgacggcgaacgaaacaatcagatcctggaggagaacatggatgttgaaatttggaccaaagagggggaaagaaagaagctccggcccaggtggctggacgcccgcacatattctgatccacttgcactgaaagagttcaaggactttgcggccggaagaaaatcgatcgctctcgatttggtcactgaaataggcagggtgcctagccatctggcccaccggacccgtaatgcactagacaacctggtgatgctccatacatcagagcacggtgggcgcgcttaccgacacgccgtcgaggaacttcccgagaccatggaaactctgttattgctgggcctcatgatcctgcttacaggaggcgcaatgctgttcctcatttccgggaagggaatcggtaaaacgagtattggcttgatctgtgttatagtgtctagcgggatgctgtggatggccgatgtaccattacagtggattgcttccgcgatcgtgctagagtttttcatgatggtcctgctcattcctgagccggaaaagcaaagaacaccccaggacaatcagcttgcctatgtggttatcggaatactgactttggcagctatcgtggccgccaacgagatgggcctgctcgaaacaaccaagagggatctgggtatgtcaaaagagccaggggtcgtatctcctaccagctaccttgacgtggacctccatcccgcaagtgcttggacactgtatgccgttgcgactacggtgattaccccaatgttgcggcacacaatcgaaaattccactgctaacgtcagcctggccgcaattgccaaccaagctgtggtcttaatgggcctagataagggatggcctatctctaaaatggacctgggcgtgcccctccttgcactggggtgctactcacaggttaatccgttgaccctgacagccgcggtgctcctgcttgtaacccattacgctataattggaccaggcttacaggccaaggcaactcgcgaggcccagaaaagaacggctgccggtatcatgaagaaccctacagtggatgggatcatgaccattgacctggatcccgtcatctatgactccaagtttgagaaacaactcggacaggttatgttgctggtgctatgtgcagtccagctgctccttatgaggacaagttgggctctgtgcgaagccttgaccctggcgacaggcccaataactaccctctgggagggtagccccggcaagttctggaatacaacgattgccgtgtcgatggcaaacatctttcgggggtcttacctggctggagccggcttagcattctccattatgaaaagcgtagggaccggacgaagaggcactggttcacagggggaaacacttggagagaagtggaaaaagaagctgaatcaactcagtcgcaaagaatttgatctatataagaaatctggcatcaccgaggtggacaggactgaggctaaggaaggtctgaaacggggcgagacaacccaccatgccgtttcccgtgggagcgccaagttgcagtggttcgtggaaagaaacatggtcatacctgagggaagggtgatcgatctgggctgtgggcgcggaggctggtcatactattgcgcgggtctcaaaaaggtcacggaagtgcgggggtacaccaagggaggcccgggccacgaggagcccgttccaatgagtacatatgggtggaatattgtaaaacttatgagcggaaaggacgtgttctacctgcctcccgaaaaatgtgatactttgctgtgcgacatcggtgagtcctctcctagcccaaccgtcgaagagtcccgaacaattagagtgctcaagatggttgagccctggctgaaaaacaatcagttttgtatcaaggtgctaaacccttacatgccaactgtcattgaacaccttgagaggctgcagcgcaagtatggcgggatgctagtgcggaatcccctctcaagaaactctacccatgaaatgtactggatcagtaatggaacaggcaacatagtatcgagcgtgaatatggtttcccgtctgttgctgaacaggttcaccatgactcaccggcgcccgacgattgagaaagatgtcgacctcggtgctgggacacgacatgtgaacgcagaacctgagaccccaaatatggacgtgatcggagagagaatcaagaggattaaagaggaacactcttcaacttggcactatgatgacgaaaacccctacaagacctgggcctatcatggcagctacgaggtcaaagctacaggctccgccagttctatgataaatggggttgtgaaacttctgacgaagccttgggatgtagtgccaatggtcacccaaatggcaatgactgacacaaccccctttggacagcagcgggtgttcaaagaaaaggttgatactcgcacaccgagacctatgcccggtaccaggaaagtgatggagatcacagccgagtggttatggcgaactctgggccggaacaagaaaccacgtttgtgcaccagagaagagtttacgaagaaggtccgcaccaatgctgcgatgggggccgtgttcacagaagagaaccaatgggacagcgcaagggctgccgtagaagatgaggagttttggaaactcgttgaccgggaaagagagctgcacaagctaggaaaatgtggctcatgcgtgtataatatgatgggtaagcgcgagaagaaacttggggagttcggaaaagcaaaaggctccagggccatttggtacatgtggctgggcgctcgatacctcgagtttgaagccctggggttcttgaacgaggatcattggtttagtcgggaaaatagctattctggagtcgagggtgaaggcctgcacaagctcgggtacatccttagagacatttccaaaatccctggaggcgcgatgtatgcagatgacactgccggttgggacaccaggataacagaggatgacctgcataacgaggaaaagatcactcagcagatggatcccgagcaccgccagttagcttcagccattttcaaactgacctaccaaaataaggtggtgaaagtccagcgtccaacgcccaaggggacagttatggacatcattagccggaaggatcagagaggatcgggccaggtgggcacctatgggttgaacacttttacaaatatggaagcacaactcgtaaggcagatggagggagaaggtgtgctgtctaaagctgacctagagaaccctcaccttctggagaagaaaatcacccagtggctcgaaactaagggcgtcgagcgcctgaaacgaatggccataagtggggatgactgcgtggttaagccaattgatgaccggttcgctaatgccttgttagcactgaacgatatgggaaaggtgagaaaagacatcccgcagtggcaaccctccaagggctggcatgattggcagcaggtccctttctgtagccaccattttcacgaactcatcatgaaagacggtaggaaacttgtggtaccatgccgcccccaggacgagctgattgggagagcgcggatatcacaaggagccggctggtccctaaaagaaaccgcttgtctgggcaaggcctacgcacagatgtggtctctcatgtatttccacaggcgtgatttgcgactggctagcaacgccatctgcagtgcagttcctgtgcattgggtcccaacatcccgcacgacctggagcattcacgcccatcaccagtggatgactacagaggacatgcttaccgtgtggaatagagtttggatcgaggataacccctggatggaagacaagactcctgtgacaacctgggaggatgtcccgtacctggggaaacgggaagaccaatggtgtggatctctcattggtttaacgtcaagggcgacatgggctcagaatatcctgaccgccatacaacaggtgcgcagtttgatcggcgatgaggagtttctggactacatgccatccatgaagagattccggaaagaagaggaaagcgagggggcaatttggtga

SEQ ID NO: 15670 - RNA, 9873 nt, synthetic construct
  misc_feature 1..9873: note = derived and/or modified CDS sequence (opt3) from DENV-3__DQ675527__SS-prME
  source 1..9873: mol_type = other RNA
accagcttctgcctgatgatgatgctccccgccacacttgcttttcacctgacttccagagacggcgagcctaggatgatcgtggggaagaacgaacggggaaaatctttgttattcaagacggcatcaggtattaatatgtgtaccctgatagccatggatctaggcgagatgtgcgacgatacagtcacttacaaatgtccactcatcgcggaagttgagccggaagacattgattgctggtgtaacctgaccagtacatgggtgacctatgggacttgcaatcaggctggagagcatcgccgagacaagcgtagcgtagcccttgcaccccacgtgggcatgggtctggatacaagaacccaaacgtggatgtccgccgagggggcttggaggcaggtcgaaaaagtggagacttgggcattgcggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactagacatcgagctccagaagaccgaagcaactcaactggccacacttaggaaactgtgtattgagggaaagatcaccaacattacgaccgatagccggtgccctacacagggcgaagctatcttgccagaggaacaggaccagaattatgtctgtaaacacacttacgttgatcgcggttgggggaacggatgcggcctctttggcaaggggagtctggtgacctgcgccaagttccaatgtttagagcccatagagggaaaagtagtgcagtatgaaaatctgaagtacacagtcattatcactgtgcacaccggtgaccagcatcaggttggcaacgacacacaaggggtgaccgtcgagattactcctcaggcatccacggtggaagctgtactcccagagtatggaacacttggcctggaatgctctccgcgaaccggtttggattttaatgagatgatcctactgactatgaaaaacaaggcctggatggttcacagacagtggttctttgacctccccctgccttggaccagcggggcgacaaccgagactccaacatggaataggaaagaacttctggtgacgttcaagaacgcccatgcaaaaaagcaagaggtcgtggtcttgggctcccaggaaggagctatgcacaccgccctcactggcgctacagagatccagaattcagggggaaccagtatttttgccggtcacctgaagtgtcggttaaaaatggataagctggaactaaaaggcatgagctacgcaatgtgcctcaacacattcgtgctgaagaaagaggtttctgagactcagcatgggaccatacttatcaaggtggaatacaagggagaggacgccccctgtaaaattcctttctccacggaagatggccaaggtaaggctcacaacgggcgtttgatcaccgcgaatccagtagtcacaaaaaaggaggagcccgtgaacatagaagcagagccgccttttggcgaatcaaatattgttatcggaatcggcgacaaagccctgaagattaactggtataagaaagggagcagtatcggaaagatgttcgaggctactgcccgcggtgcaagaaggatggccattctcggcgataccgcttgggactttgggtctgtgggaggcgtcctgaattcccttggtaaaatggtgcatcagatattcgggagcgcctacacagcactgttttcgggcgtatcttggatcatgaagattggaatcggcgtgttgctcacttggatcgggctgaactccaaaaatacctcaatgagtttcagctgcattgttataggaatcattacgttatatctgggcgcggtcgtgcaggctgatatgggttgtgtgatcaactggaaggggaaggaactaaaatgcggatccggcatttttgtcacaaatgaggttcacacctggactgagcagtacaagttccaagccgactctcccaaacggctcgcaacagccatcgctggtgcctgggaaaacggcgtgtgtgggatacgaagcaccactcgcatggagaatctgctttggaagcagatcgcaaacgaattgaattatattctgtgggagaacaatatcaaactcaccgtggtagtcggagatattatcggcgtgctggaacaggggaagagaacattaacgccacagcctatggagctgaaatactcatggaagacctggggaaaggctaaaatagttactgccgagattcaaaacagttcctttatcattgacggccccaacacaccagaatgccccagcgcgtctagggcctggaatgtgtgggaggtcgaagactatggtttcggggtgtttaccacaaacatctggcttaagttgcgggagatgtacactcagtcatgtgatcatcgcctcatgagtgctgcaataaaagacgaaagagccgttcacgctgatatgggatactggatcgagagccagaagaatggctcctggaaactggagaaggcctctttcattgaagtgaagacctgcacgtggcctaaatcgcacacactatggagcaacggtgtactggagtccgacatgatcattccaaagtcactcgcaggcccgatcagtcagcataatcacaggcccgggtatcatacccaaactgcgggaccttggcacctgggcaaacttgaattggattttaactactgcgaggggaccacagtcgtgataactgagaattgtggaacccgtggcccatctctgcggacaacgaccgtgagcggtaagttaattcacgaatggtgctgtcgatcctgcactctcccccctctgagatatatgggggaggacggatgttggtacggcatggaaatcaggccaatcaacgagaaagaagagaatatggtcaagtcacttgttagcgccggttctggcaaggtggataacttcacaatgggggtactgtgcttggctattctcttcgaggaagtgatgcgcggaaaatttggcaagaaacatatgatcgtcggggtgctgttcacctttgttctactgctctccggacagattacttggcgggacatggcccacacactgataatgatcggcagtaatgcaagcgatagaatgggtatgggggtgacctatcttgctttgattgccacgttcaagatccagccctttctggcattaggattctttctcaggaaactgacttctcgcgagaaccttctgctaggcgtcggcctcgccatggctaccacactgcaattgccggaagacattgagcagatggcgaatgggatcgccctgggattaatgaccctcaagctgataactcagttcgaaacataccagctttggaccgcactggtgtccttgacatgttcaaacactatctttaccctcacggttgcttggcgaacagccaccctgattctagccggtgtgagtctgcttcctctctgccaaagctcgtccatgcggaagactgattggctgccaatgaccgtcgctgcaatgggcgtaccccctttgcccctgttcatcttttctttaaaagacacaccaaagcgtagaagctggcctctcaatgagggggtgatggccgttggactggtgtcaattcttgcgagttccctgttgaggaacgatgtccccatggctggcccactcgtggccggtgggctgctaatcgcatgttatgtaataactggaacctctgccgacctgacggtggagaaagctgcagacgtcacatgggaagaggaagccgagcagaccggcgttagccataaccttatgattactgtggatgacgatggcacaatgcgcatcaaggacgatgaaaccgagaatatcctcactgtgctgttgaaaacagcgttactgattgtctccgggatattcccgtactcaatccctgctaccctcctggtgtggcacacgtggcagaagcagactcaacggagcggagttctttgggacgtacccagtccacccgagacccagaaagccgaactggaggaaggtgtgtacagaattaagcagcagggcatctttgggaagacacaagtcggagtgggcgttcagaaagagggtgtgttccataccatgtggcacgtcacaaggggggcagtgttgactcacaacggaaagcgactagagcctaattgggcctctgtaaaaaaggatctgatttcctatggcggcgggtggcgcctcagcgctcagtggcaaaaaggagaagaggtccaggtgatcgccgttgaaccaggtaagaaccccaagaatttccagaccatgcctggcatatttcagacgacaactggggagatcggagcaattgctctggacttcaaaccgggcacctcgggttcaccaatcattaaccgggaagggaaggtggtcggactttacggcaatggcgtggttacaaaaaacgggggatatgtgtctggtatcgcccaaaccaatgcggagcccgatggccctactccagagttagaagaggaaatgtttaagaaaagaaacctgaccataatggacctccatcccgggagtggaaagacaaggaagtacttgcctgccattgtccgtgaggcaatcaaacgccggctgagaacgctcatcctggctccgactagggtggtagccgctgaaatggaggaggcacttaagggcctgcccattcgatatcagaccacagccaccaaatccgaacacactggtcgggagatcgtggatttgatgtgccatgccacattcaccatgcgcctactgagcccagttagagtccctaattacaacctcataattatggacgaagctcactttacggatcccgcgtctatcgcagccagggggtatattagcactcgggtgggaatgggcgaggctgccgcaatcttcatgacagccaccccacctggcaccgctgaagcgtttccccagtccaatgccccaatacaggacgaggagcgagacattccggaaagatcatggaacagtgggaatgagtggatcactgatttcgtgggaaagacagtctggtttgtacctagcatcaaagcaggtaacgacattgctaactgtttacgcaagaatggcaagaaagtgatccaactgtctaggaagaccttcgatacagaataccagaaaactcgtcttaacgactgggattttgttgtgacgaccgacatttccgagatgggggccaatttcaaggcagatcgggtcatagaccccagaaggtgcctgaaaccagtgatcctcacagatggacccgagcgcgttattttggccggccctatgccagtgactgctgcctcagcggcacagcgaagaggtcgggtcgggaggaacccccagaaggaaaatgaccaatacatcttcaccggccagcctctgaacaatgatgaggaccatgcccactggacagaagctaagatgctcctggacaacatcaataccccggagggaattataccagccctttttgaacccgagcgcgagaaaagtgctgcaatcgatggcgaatatcgtctaaagggggagagcagaaaaactttcgtggaactgatgcggaggggagacttgcctgtatggttagcccacaaggtggcttccgagggtattaaatacacggatcgcaagtggtgctttgacggcgaacgaatcaaccagattctggaggagaatatggatgttgaaatctggaccaaagagggggaaagaaagaacctccggcccaggtggctggacgcccgcacatattctgatccacttgcactgaaggagttcaaagactttgcggccggaagaaagtcgatagctctcgatttggtcactgaaatcggcagggtgcctagccatctggcccaccggacccgtaatgcactagacaacctggtgatgctccatacatcagagcacggtgggcgcgcttaccgacacgccgtcgaggaacttcccgagaccatggaaactctgttattgctgggcctcatgattctgcttacaggaggcgcaatgctgttcctcatctccgggaaaggaattggtaagacgagtatcggcttgatatgtgttattgtgtctagcgggatgctgtggatggccgatgtaccattacagtggatcgcttccgcgattgtgctagagtttttcatgatggtcctgctcatccctgagccggaaaaacaaagaaccccccaggacaatcagcttgcctatgtggttataggaatcctgactttggcagctattgtggccgccaacgagatgggcctgctcgaaacaaccaagagggatctgggtatgtcaaaggagccaggggtcgtatctcctaccagctaccttgacgtggacctccatcccgcaagtgcttggacactgtatgccgttgcgactacggtgatcaccccaatgttgcggcacacaattgaaaattccactgctaacgtcagcctggccgcaatcgccaaccaagctgtggtcttaatgggcctagataaaggatggcctatatctaagatggacctgggcgtgcccctccttgcactggggtgctactcacaggttaatccgttgaccctgacagccgcggtgctcctgcttgtaacccattacgctattatcggaccaggcttacaggccaaagcaactcgcgaggcccagaagagaacggctgccggtatcatgaaaaaccctacagtggatgggattatgaccatcgacctggatcccgtcatatatgactccaagtttgagaagcaactcggacaggttatgttgctggtgctatgtgcagtccagctgctccttatgaggactagttgggctctgtgcgaagccttgaccctggcgacaggcccaattactaccctctgggagggtagccccggcaaattctggaatacaacgatcgccgtgtcgatggcaaacatttttcgggggtcttacctggctggagccggcttagcattctccatcatgaagagcgtagggaccggacgaagaggcactggttcacagggggaaacacttggagagaaatggaagaaaaagctgaatcaactcagtcgcaaggaatttgatctatataaaaagtctggcataaccgaggtggacaggactgaggctaaagaaggtctgaagcggggcgagacaacccaccatgccgtttcccgtgggagcgccaaattgcagtggttcgtggaaagaaacatggtcatccctgagggaagggtgattgatctgggctgtgggcgcggaggctggtcatactattgcgcgggtctcaagaaagtcacggaagtgcgggggtacaccaagggaggcccgggccacgaggagcccgttccaatgagtacatatgggtggaatatcgtaaagcttatgagcggaaaagacgtgttctacctgcctcccgaaaagtgtgatactttgctgtgcgacattggtgagtcctctcctagcccaaccgtcgaagagtcccgaacaatcagagtgctcaaaatggttgagccctggttaaagaacaatcagttttgtattaaagtgctgaacccttacatgccaactgtcatcgaacaccttgagaggctgcagcgcaagtatggcgggatgctagtgcggaatcccctctcaagaaactctacccatgaaatgtactggataagtaatggaacaggcaacattgtatcgagcgtgaatatggtttcccgtctgttgctgaacaggttcaccatgactcaccggcgcccgacgatcgagaaggatgtcgacctcggtgctgggacacgacatgtgaacgcagaacctgagaccccaaatatggacgtgatcggagagagaattaaaaggataaaggaagagcactcttcaacttggcactatgatgacgaaaacccctacaaaacctgggcctatcatggcagctacgaggtcaaggctacaggctccgccagttctatgatcaatggggttgtgaaacttctgacgaagccttgggatgtagtgccaatggtcacccaaatggcaatgactgacacaaccccctttggacagcagcgggtgttcaaggaaaaagttgatactcgcacaccgagacctatgcccggtaccaggaaggtgatggagattacagccgagtggttatggcgaactctgggccggaacaaaaagccacgtttgtgcaccagagaagagtttacgaaaaaggtccgcaccaatgctgcgatgggggccgtgttcacagaagagaaccaatgggacagcgcaagggctgccgtagaagatgaggagttttggaagctcgttgaccgggaaagagagctgcacaaactaggaaagtgtggctcatgcgtgtataatatgatgggtaaacgcgaaaagaaacttggggagttcggaaaggcaaaaggctccagggccatctggtacatgtggctgggcgctcgatacctcgagtttgaagccctggggttcttgaacgaggatcattggtttagtcgggaaaatagctattctggagtcgagggtgaaggcctgcacaagctcgggtacattcttagagacatctccaagatacctggaggcgcgatgtatgcagatgacactgccggttgggacaccaggatcacagaggatgacctgcataacgaggaaaaaattactcagcagatggatcccgagcaccgccagttagcttcagccatcttcaagctgacctaccaaaataaagtggtgaaggtccagcgtccaacgcccaaagggacagttatggacattatcagccggaaggatcagagaggatcgggccaggtgggcacctatgggttgaacacttttacaaatatggaagcacaactcgtaaggcagatggagggagaaggtgtgctgtctaaggctgacctagagaaccctcaccttctggagaaaaagataacccagtggctcgaaactaaaggcgtcgagcgcctgaagcgaatggccattagtggggatgactgcgtggttaaaccaatcgatgaccggttcgctaatgccttgttagcactgaacgatatgggaaaggtgagaaaggacatcccgcagtggcaaccctccaaaggctggcatgattggcagcaggtccctttctgtagccaccattttcacgaactcattatgaaggacggtaggaaacttgtggtaccatgccgcccccaggacgagctgatagggagagcgcggatctcacaaggagccggctggtccctaaaggaaaccgcttgtctgggcaaagcctacgcacagatgtggtctctcatgtatttccacaggcgtgatttgcgactggctagcaacgccatttgcagtgcagttcctgtgcattgggtcccaacatcccgcacgacctggagcatccacgcccatcaccagtggatgactacagaggacatgcttaccgtgtggaatagagtttggattgaggataacccctggatggaagacaagactcctgtgacaacctgggaggatgtcccgtacctggggaagcgggaagaccaatggtgtggatctctcatcggtttaacgtcaagggcgacatgggctcagaatatactgaccgccatccagcaggtgcgcagtttgattggcgatgaggagtttctggactacatgccatccatgaaaagattccggaaggaagaggaaagcgagggggcaatctggtga

SEQ ID NO: 15671 - RNA, 9873 nt, synthetic construct
  misc_feature 1..9873: note = derived and/or modified CDS sequence (opt3) from DENV-3__DQ675528__SS-prME
  source 1..9873: mol_type = other RNA
accagcttctgcctgatgatgatgctccccgccacacttgcttttcacctgacttccagagacggcgaacctaggatgatcgtggggaagaacgaacggggaaaatctttgttattcaagacggcatcaggtattaatatgtgtaccctgatagccatggatttaggcgaaatgtgcgacgatacagtcacttacaaatgtccactcatcgcggaagttgagccggaagacattgattgctggtgtaacctgaccagtacatgggtgacctatgggacttgcaatcaggctggagagcatcgccgagacaagcgtagcgtagcccttgcaccccacgtgggcatgggtctggatacaagaacccagacgtggatgtccgccgagggggcttggaggcaggtcgaaaaagtggagacttgggcattgcggcatcctggatttaccatcctcgccctgttcctggctcactacattggcacatctctcactcagaaggttgtgatctttatattactgatgcttgtcaccccatcgatgacaatgcgctgtgtgggcgtagggaacagagacttcgttgaaggattgtcaggtgccacctgggtggatgtcgtgctggagcatggcgggtgcgtgacgactatggcgaagaataaacccacactcgacatcgagctccagaagaccgaagcaactcagctggccacacttaggaaactgtgtattgagggaaagatcaccaacattacgaccgatagccggtgccctacacagggcgaagctatcttgccagaggaacaggaccagaattatgtctgtaaacacacttacgttgatcgcggttgggggaacggatgcggcctctttggcaaggggagtctggtgacctgcgccaagttccaatgtttagagcccatagagggaaaagtagtgcagtatgaaaatctgaagtacacagtcattatcactgtgcacaccggtgaccagcatcaggttggcaacgacacacaaggggtgaccgtcgagattactcctcaggcatccacggtggaagctgtactcccagagtatggaacacttggcctggaatgctctccgcgaaccggtttggattttaatgagatgatcctgctgactatgaaaaacaaggcctggatggttcacagacagtggttctttgacctccccctgccttggaccagcggggcgacaaccgagactccaacatggaataggaaagaacttctggtgacgttcaagaacgcccatgccaagaagcaagaggtcgtggtcttgggctcccaggaaggagctatgcacaccgtgctcactggcgccacagagatccaaaattcagggggaaccagtatttttgctggtcacctgaagtgtcggttaaaaatggataagctggaactaaaaggcatgagctacgccatgtgcctcaacacattcgttctgaagaaagaggtgtctgagactcagcatgggaccatacttatcaaggtagaatacaagggagaggacgcaccctgtaaaattcctttctccacggaagatggccaaggtaaggcccacaacgggcgtttgatcaccgctaatccagtcgtgactaagaaggaggagcccgttaacatagaagcggagccgccttttggcgaatcaaatattgtgatcggaatcggcgacaaagcactgaagattaactggtataagaaagggagcagtatcggaaagatgttcgaggccactgctcgcggtgccagaaggatggcaattctcggcgataccgcctgggactttgggtctgtcggaggcgtgctaaattcccttggtaaaatggtacatcagatattcgggagcgcttacacagccctgttttcgggcgtgtcttggatcatgaagattggaatcggcgttttgctcacttggatcgggctgaactccaaaaatacctcaatgagtttcagctgcattgtcataggaatcattacgttatatctgggcgcagtggtgcaggcggatatgggttgtgtcatcaactggaaggggaaggaactaaaatgcggatccggcatttttgttacaaatgaggtgcacacctggactgagcagtacaagttccaagctgactctcccaaacggctcgccacagcaatcgccggtgcttgggaaaacggcgtgtgtgggatacgaagcaccactcgcatggagaatctgctttggaagcagatcgccaacgaattgaattatattctgtgggagaacaatatcaaactcaccgtagtcgtgggagatattatcggcgttctggaacaggggaagagaacattaacgccacagcctatggagctgaaatactcatggaagacctggggaaaggcaaaaatagtgactgctgagattcaaaacagttcctttatcattgacggccccaacacaccagaatgccccagcgcctctagggcgtggaatgtctgggaggtggaagactatggtttcggggtttttaccacaaacatctggcttaagttgcgggagatgtacactcagtcatgtgatcatcgcctcatgagtgccgctataaaagacgaaagagcagtgcacgccgatatgggatactggatcgagagccagaagaatggctcctggaaactggagaaggcttctttcattgaagtaaagacctgcacgtggcctaaatcgcacacactatggagcaacggtgtcctggagtccgacatgatcattccaaagtcactcgccggcccgatcagtcagcataatcacaggcccgggtatcatacccaaactgcaggaccttggcacctgggcaaacttgaattggattttaactactgcgaggggaccacagtggtgataactgagaattgtggaacccgtggcccatctctgcggacaacgaccgtcagcggtaagttaattcacgaatggtgctgtcgatcctgcactctaccccctctgagatatatgggggaggacggatgttggtacggcatggaaatcaggccaatcaacgagaaagaagagaatatggttaagtcacttgtgagcgcgggttctggcaaggtagataacttcacaatgggggtgctgtgcttggccattctcttcgaggaagtcatgcgcggaaaatttggcaagaaacatatgatcgtgggggttctgttcacctttgtgctactgctctccggacagattacttggcgggacatggctcacacactgataatgatcggcagtaatgccagcgatagaatgggtatgggggtcacctatcttgcattgattgctacgttcaagatccagccctttctggccttaggattctttctcaggaaactgacttctcgcgagaaccttctgctaggcgtgggcctcgcaatggccaccacactgcaattgccggaagacattgagcagatggctaatgggatcgcgctgggattaatgaccctcaagctgataactcagttcgaaacataccagctttggaccgccctggtttccttgacatgttcaaacactatctttaccctcacggtggcatggcgaacagctaccctgattctagccggtgtcagtctgcttcctctctgccaaagctcgtccatgcggaagactgattggctgccaatgaccgtagccgctatgggcgtgccccctttgcccctgttcatcttttctttaaaagacacaccaaagcgtagaagctggcctctcaatgagggggttatggcagtgggactggtctcaattcttgccagttccctgttgaggaacgatgtgcccatggcgggcccactcgtagctggtgggctgctaatcgcctgttatgtgataactggaacctctgcagacctgacggtcgagaaagccgctgacgttacatgggaagaggaagcagagcagaccggcgtgagccataaccttatgattactgtggatgacgatggcacaatgcgcatcaaggacgatgaaaccgagaatatcctcactgtcctgttgaaaacagccttactgattgtgtccgggatattcccgtactcaatccctgcgaccctcctggtttggcacacgtggcagaagcagactcaacggagcggagtactttgggacgtgcccagtccacccgagacccagaaagctgaactggaggaaggtgtctacagaattaagcagcagggcatctttgggaagacacaagtgggagttggcgtgcagaaagagggtgtcttccataccatgtggcacgtgacacgaggggcagtattgactcacaacggaaagaggctagagcctaattgggcatctgtcaaaaaggatctgatttcctatggcggcgggtggcgcctcagcgcccagtggcaaaaaggagaagaggtgcaggttatcgctgtggaaccaggtaagaaccccaagaatttccagaccatgcctggcatatttcagacgacaactggggagatcggagccattgcactggacttcaaaccgggcacctcgggttcaccaatcattaaccgggaagggaaggtcgtgggactttacggcaatggcgttgtgaccaagaacgggggatatgtctctggtatcgctcaaaccaatgccgagcccgatggccctactccagagttagaagaggaaatgtttaagaaaagaaacctgaccataatggacctccatcccgggagtggaaagacaaggaagtacttgcctgcgattgtgcgtgaggccatcaaacgccggctgagaacgctcatcctggcaccgactagggtagtggctgccgaaatggaggaggctcttaagggcctgcccattcgatatcagaccacagcaaccaaatccgaacacactggtcgggagatcgttgatttgatgtgccatgccacattcaccatgcgcctactgagcccagtcagagtgcctaattacaacctcataattatggacgaagcccactttacggatcccgcttctatcgcggcaagggggtatattagcactcgggtgggaatgggcgaggccgctgccatcttcatgacagcaaccccacctggcaccgccgaggcttttccccagtccaatgcgccaatacaggacgaggagcgagacattccggaaagatcatggaacagtgggaatgagtggatcactgatttcgtcggaaagacagtatggtttgtgcctagcatcaaagccggtaacgacattgcaaactgtttacgcaagaatggcaagaaagttatccaactgtctaggaagaccttcgatacagaataccagaaaactcgtcttaacgactgggattttgtggtcacgaccgacatttccgagatgggggctaatttcaaggccgatcgggtgatagaccccagaaggtgcctgaaaccagttatcctcacagatggacccgagcgcgtgattttggcaggccctatgccagtcactgccgcttcagccgcgcagcgaagaggtcgggtggggaggaacccccagaaggaaaatgaccaatacatcttcaccggccagcctctgaacaatgatgaggaccatgcacactggacagaagccaagatgctcctggacaacatcaataccccggagggaattataccagctctttttgaacccgagcgcgagaaaagtgccgctatcgatggcgaatatcgtctaaagggggagagcagaaaaactttcgtagaactgatgcggaggggagacttgcctgtgtggttagcacacaaggttgcctccgagggtattaaatacacggatcgcaagtggtgctttgacggcgaacgaaacaatcagatcctggaggagaacatggatgtcgaaatttggaccaaagagggggaaagaaagaagctccggcccaggtggctggacgctcgcacatattctgatccacttgccctgaaagagttcaaggactttgcagcgggaagaaaatcgatcgccctcgatttggtgactgaaataggcagggtgcctagccatctggctcaccggacccgtaatgccctagacaacctggtcatgctccatacatcagagcacggtgggcgcgcataccgacacgctgttgaggaacttcccgagaccatggaaactctgttattgctgggcctcatgatcctgcttacaggaggcgccatgctgttcctcatttccgggaagggaatcggtaaaacgagtattggcttgatctgtgtgatagtatctagcgggatgctgtggatggcagatgtgccattacagtggattgcctccgctatcgtcctagagtttttcatgatggtgctgctcattcctgagccggaaaagcaaagaacaccccaggacaatcagcttgcgtatgttgtgatcggaatactgactttggccgcaatcgtcgctgccaacgagatgggcctgctcgaaacaaccaagagggatctgggtatgtcaaaagagccaggggtagtgtctcctaccagctaccttgacgttgacctccatcccgccagtgcatggacactgtatgctgtggccactacggtcattaccccaatgttgcggcacacaatcgaaaattccactgcgaacgtgagcctggctgccattgcaaaccaagccgtcgtgttaatgggcctagataagggatggcctatctctaaaatggacctgggcgttcccctccttgctctggggtgctactcacaggtgaatccgttgaccctgacagcagccgtactcctgcttgtgacccattacgcgataattggaccaggcttacaggctaaggccactcgcgaggcacagaaaagaacggccgctggtatcatgaagaaccctacagtcgatgggatcatgaccattgacctggatcccgttatctatgactccaagtttgagaaacaactcggacaggtgatgttgctggtcctatgtgccgtgcagctgctccttatgaggacaagttgggcactgtgcgaggctttgaccctggccacaggcccaataactaccctctgggagggtagccccggcaagttctggaatacaacgattgcggtatcgatggccaacatctttcgggggtcttacctggcaggagctggcttagccttctccattatgaaaagcgtggggaccggacgaagaggcactggttcacagggggaaacacttggagagaagtggaaaaagaagctgaatcaactcagtcgcaaagaatttgatctatataagaaatctggcatcaccgaggttgacaggactgaggcaaaggaaggtctgaaacggggcgagacaacccaccatgctgtgtcccgtgggagcgccaagttgcagtggttcgtcgaaagaaacatggtgatacctgagggaagggtcatcgatctgggctgtgggcgcggaggctggtcatactattgcgccggtctcaaaaaggtgacggaagttcgggggtacaccaagggaggcccgggccacgaggagcccgtaccaatgagtacatatgggtggaatattgtgaaacttatgagcggaaaggacgtcttctacctgcctcccgaaaaatgtgatactttgctgtgcgacatcggtgagtcctctcctagcccaaccgtggaagagtcccgaacaattagagttctcaagatggtggagccctggctgaaaaacaatcagttttgtatcaaggtcctaaacccttacatgccaactgtgattgaacaccttgagaggctgcagcgcaagtatggcgggatgctagtacggaatcccctctcaagaaactctacccatgaaatgtactggatcagtaatggaacaggcaacatagtgtcgagcgttaatatggtctcccgtctgttgctgaacaggttcaccatgactcaccggcgcccgacgattgagaaagatgtggacctcggtgcggggacacgacatgtgaacgctgaacctgagaccccaaatatggacgtcatcggagagagaatcaagaggattaaagaagaacactcttcaacttggcactatgatgacgaaaacccctacaagacctgggcatatcatggcagctacgaggttaaagccacaggctccgctagttctatgataaatggggtggtaaaacttctgacgaagccttgggatgtggtcccaatggtgacccaaatggccatgactgacacaaccccctttggacagcagcgggttttcaaagaaaaggtggatactcgcacaccgagacctatgcccggtaccaggaaagtcatggagatcacagcagagtggttatggcgaactctgggccggaacaagaaaccacgtttgtgcaccagagaagagtttacgaagaaggtgcgcaccaatgccgctatgggggcggtattcacagaagagaaccaatgggacagcgccagggcagctgttgaagatgaggagttttggaaactcgtggaccgggaaagagagctgcacaagctaggaaaatgtggctcatgcgtctataatatgatgggtaagcgcgagaagaaacttggggagttcggaaaagccaaaggctccagggcaatttggtacatgtggctgggcgcccgatacctcgagtttgaagctctggggttcttgaacgaggatcattggtttagtcgggaaaatagctattctggagtggagggtgaaggcctgcacaagctcgggtacatccttagagacatttccaaaatccctggaggcgccatgtatgcggatgacactgcaggttgggacaccaggataacagaggatgacctgcataacgaggaaaagatcactcagcagatggatcccgagcaccgccagttagcctcagctattttcaaactgacctaccaaaataaggtggtcaaagttcagcgtccaacgcccaaggggacagtgatggacatcattagccggaaggatcagagaggatcgggccaggtaggcacctatgggttgaacacttttacaaatatggaagcccaactcgtgaggcagatggagggagaaggtgtcctgtctaaagcagacctagagaaccctcaccttctggagaagaaaatcacccagtggctcgaaactaagggcgtggagcgcctgaaacgaatggctataagtggggatgactgcgttgtgaagccaattgatgaccggttcgccaatgctttgttagccctgaacgatatgggaaaggtcagaaaagacatcccgcagtggcaaccctccaagggctggcatgattggcaacaggtgcctttctgtagccaccattttcacgaactcatcatgaaagacggtaggaaacttgtagttccatgccgcccccaggacgagctgattgggagagcacggatatcacaaggagcgggctggtccctaaaagaaaccgcctgtctgggcaaggcttacgcccagatgtggtctctcatgtatttccacaggcgtgatttgcgactggcaagcaacgctatctgcagtgccgtgcctgtccattgggtgccaacatcccgcacgacctggagcattcacgcacatcaccagtggatgactacagaggacatgcttaccgtttggaatagagtgtggatcgaggataacccctggatggaagacaagactcctgtcacaacctgggaggatgtgccgtacctggggaaacgggaagaccaatggtgtggatctctcattggtttaacgtcaagggccacatgggcgcagaatatcctgaccgctatacagcaggtacgcagtttgatcggcgatgaggagtttctggactacatgccatccatgaagagattccggaaagaagaggaaagcgagggggccatttggtga

SEQ ID NO: 15672 - RNA, 9873 nt, synthetic construct
  misc_feature 1..9873: note = derived and/or modified CDS sequence (opt3) from DENV-3__DQ675530__SS-prME
  source 1..9873: mol_type = other RNA
actagcttctgcctgatgatgatgctccccgcaacacttgcttttcacctgacatccagggacggcgaacctaggatgatcgtggggaagaacgaacggggaaaatctttgttattcaagacggcatcaggtattaatatgtgtaccctgatagccatggatcttggcgagatgtgcgacgatacagtaacttacaaatgtccactcatcgcggaagttgagccggaagacattgattgctggtgtaacctgaccagtacatgggtgacctatgggacttgcaatcaggctggagagcatcgccgagacaagcgtagcgtggcccttgcaccccacgtgggcatgggtctggatacaagaacccagacgtggatgtccgccgagggggcttggaggcaggtcgaaaaagtggagacttgggcattgcggcatcctggatttaccatcctcgccctgttcctggctcactacattggcacatctccaactcagaaggttgtgatctttatactcttaatgctggtcaccccctcgatgacaatgcgctgtgtgggcgtagggaacagagacttcgttgaaggactttcaggtgccacctgggtggatgtcgtgttggagcatggcgggtgcgtgacgactatggcgaagaataaacctacactggacatcgagctacagaagaccgaagcaactcagctcgccacactgaggaaactttgtattgagggaaagatcaccaacattacgaccgatagccggtgcccaacacagggcgaagctatcctgcccgaggaacaggaccagaattatgtctgtaaacacacttacgttgatcgcggttgggggaacggatgcggcttgtttggcaaggggagtctcgtgacctgcgccaagttccaatgtctggagcctatagagggaaaagtagtgcagtatgaaaatttaaagtacacagtcattatcactgtgcacaccggtgaccagcatcaggttggcaacgacacacaaggggtgaccgtcgagattactccacaggcatccacggtggaagctgtactgccggagtatggaacactcggccttgaatgctctccccgaaccggtctggattttaatgagatgatcttgctaactatgaaaaacaaggcctggatggttcacagacagtggttctttgacctgcctctcccatggaccagcggggcgacaaccgagactcccacatggaataggaaagaactgcttgtgacgttcaagaacgcccatgccaagaagcaagaggtcgtggtcctgggctcccaggaaggagctatgcacaccgccttgactggcgctacagagatccaaaattcagggggaaccagtatttttgccggtcacctcaagtgtcggctgaaaatggataagttagaactgaaaggcatgagctacgcaatgtgcctaaacacattcgtgctcaagaaagaggtttctgagactcagcatgggaccatactgatcaaggtggaatacaagggagaggacgccccttgtaaaattccattctccacggaagatggccaaggtaaggctcacaacgggcgtcttatcaccgcgaatcccgtagtcactaagaaggaggagccggtgaacatagaagcagagcctccctttggcgaatcaaatattgttatcggaatcggcgacaaagccttgaagattaactggtataagaaagggagcagtatcggaaagatgttcgaggctactgcccgcggtgcaagaaggatggccattctgggcgataccgcttgggactttgggtctgtgggaggcgtcctcaattccctgggtaaaatggtgcatcagatattcgggagcgcctacacagcactattttcgggcgtatcttggatcatgaagattggaatcggcgtgctgttgacttggatcgggctcaactccaaaaatacctcaatgagtttcagctgcattgttataggaatcattacgctgtatttaggcgcggtcgtgcaggctgatatgggttgtgtgatcaactggaaggggaaggaactgaaatgcggatccggcatttttgtcacaaatgaggttcacacctggactgagcagtacaagttccaagccgactctccaaaacggctagcaacagccatcgctggtgcctgggaaaacggcgtgtgtgggatacgaagcaccactcgcatggagaatctcctgtggaagcagatcgcaaacgaacttaattatattttgtgggagaacaatatcaaactgaccgtggtagtcggagatattatcggcgtgctcgaacaggggaagagaacactgacgcctcagcccatggagttaaaatactcatggaagacctggggaaaggctaaaatagttactgccgagattcaaaacagttcctttatcattgacggcccaaacacacccgaatgccctagcgcgtctagggcctggaatgtgtgggaggtcgaagactatggtttcggggtgtttaccacaaacatctggctgaaacttcgggagatgtacactcagtcatgtgatcatcgcttgatgagtgctgcaataaaagacgaaagagccgttcacgctgatatgggatactggatcgagagccagaagaatggctcctggaaactcgagaaggcctctttcattgaagtgaagacctgcacgtggccaaaatcgcacacactgtggagcaacggtgtactagagtccgacatgatcattccgaagtcactggcaggccccatcagtcagcataatcacaggcctgggtatcatacccaaactgcgggaccatggcacctcggcaaactggaacttgattttaactactgcgaggggaccacagtcgtgataactgagaattgtggaacccgtggcccctctttgcggacaacgaccgtgagcggtaagctgattcacgaatggtgctgtcgatcctgcactttacctccactcagatatatgggggaggacggatgttggtacggcatggaaatcaggcccatcaacgagaaagaagagaatatggtcaagtcactggttagcgccggttctggcaaggtggataacttcacaatgggggtactttgcctggctattttgttcgaggaagtgatgcgcggaaaatttggcaagaaacatatgatcgtcggggtactcttcacctttgttctgctactgtccggacagattacttggcgggacatggcccacacactcataatgatcggcagtaatgcaagcgatagaatgggtatgggggtgacctatctggctcttattgccacgttcaagatccagccgtttttggcactgggattctttttaaggaaactcacttctcgcgagaacctgcttctgggcgtcggcctagccatggctaccacactccaactgcctgaagacattgagcagatggcgaatgggatcgccttgggactgatgaccttaaagctcataactcagttcgaaacataccagctgtggaccgcacttgtgtccctgacatgttcaaacactatctttaccttgacggttgcttggcgaacagccaccctcattctggccggtgtgagtctactgccactttgccaaagctcgtccatgcggaagactgattggctccccatgaccgtcgctgcaatgggcgtacctcccctgccattgttcatcttttctctgaaagacacacctaagcgtagaagctggcccttaaatgagggggtgatggccgttggactcgtgtcaattctggcgagttcccttctgaggaacgatgtcccaatggctggcccgttggtggccggtgggctcctgatcgcatgttatgtaataactggaacctctgccgacctaacggtggagaaagctgcagacgtcacatgggaagaggaagccgagcagaccggcgttagccataacctgatgattactgtggatgacgatggcacaatgcgcatcaaggacgatgaaaccgagaatatccttactgtgctcctgaaaacagcgttgttaattgtctccgggatattcccttactcaatccccgctaccctgctcgtgtggcacacgtggcagaagcagactcaacggagcggagttctgtgggacgtaccaagtccccctgagacccagaaagccgaacttgaggaaggtgtgtacagaattaagcagcagggcatctttgggaagacacaagtcggagtgggcgttcagaaagagggtgtgttccataccatgtggcacgtcacaagaggggcagtgctgactcacaacggaaagcgattggagccaaattgggcctctgtcaaaaaggatctaatttcctatggcggcgggtggcgcctgagcgctcagtggcaaaaaggagaagaggtccaggtgatcgccgttgaacccggtaagaaccctaagaatttccagaccatgccgggcatatttcagacgacaactggggagatcggagcaattgctctcgacttcaaaccaggcacctcgggttcacccatcattaaccgggaagggaaggtggtcggactgtacggcaatggcgtggttaccaaaaacgggggatatgtgtctggtatcgcccaaaccaatgcggagcctgatggcccaactcccgagcttgaagaggaaatgtttaagaaaagaaacttaaccataatggacctgcatcctgggagtggaaagacaaggaagtacctcccggccattgtccgtgaggcaatcaaacgccggttgagaacgctgatcctcgctcccactagggtggtagccgctgaaatggaggaggcactgaagggccttccaattcgatatcagaccacagccaccaaatccgaacacactggtcgggagatcgtggatctgatgtgccatgccacattcaccatgcgcttgctaagccctgttagagtccccaattacaacctgataattatggacgaagctcactttacggatccagcgtctatcgcagccagggggtatattagcactcgggtgggaatgggcgaggctgccgcaatcttcatgacagccacccctcccggcaccgctgaagcgtttccacagtccaatgccccgatacaggacgaggagcgagacattcctgaaagatcatggaacagtgggaatgagtggatcactgatttcgtgggaaagacagtctggtttgtacccagcatcaaagcaggtaacgacattgctaactgtctccgcaagaatggcaagaaagtgatccaattatctaggaagaccttcgatacagaataccagaaaactcgtctgaacgactgggattttgttgtgacgaccgacatttccgagatgggggccaatttcaaggcagatcgggtcatagacccaagaaggtgccttaaacccgtgatcctgacagatggacctgagcgcgttattctcgccggcccaatgcccgtgactgctgcctcagcggcacagcgaagaggtcgggtcgggaggaaccctcagaaggaaaatgaccaatacatcttcaccggccagccgttgaacaatgatgaggaccatgcccactggacagaagctaagatgctgctcgacaacatcaataccccagagggaattatacccgccctgtttgaacctgagcgcgagaaaagtgctgcaatcgatggcgaatatcgtcttaagggggagagcagaaaaactttcgtggaactaatgcggaggggagacctgcccgtatggttggcccacaaggtggcttccgagggtattaaatacacggatcgcaagtggtgctttgacggcgaacgaaacaatcagatcttagaggagaacatggatgttgaaatttggaccaaagagggggaaagaaagaagctgcggccaaggtggctcgacgcccgcacatattctgatcctctggcacttaaagagttcaaggactttgcggccggaagaaaatcgatcgctctggatctcgtcactgaaataggcagggtgcccagccatttggcccaccggacccgtaatgcactggacaacctagtgatgctgcatacatcagagcacggtgggcgcgcttaccgacacgccgtcgaggaactcccagagaccatggaaactcttctgttattgggcctgatgatcctcctgacaggaggcgcaatgcttttcctgatttccgggaagggaatcggtaaaacgagtattggcctcatctgtgttatagtgtctagcgggatgttgtggatggccgatgtacctctgcagtggattgcttccgcgatcgtgttagagtttttcatgatggtcctactgattccggagcccgaaaagcaaagaaccccacaggacaatcagctcgcctatgtggttatcggaatacttactctggcagctatcgtggccgccaacgagatgggcttgctggaaacaaccaagagggatctcggtatgtcaaaagagcctggggtcgtatctcccaccagctacctggacgtggaccttcatccagcaagtgcttggacactctatgccgttgcgactacggtgattacccctatgctgcggcacacaatcgaaaattccactgctaacgtcagcttggccgcaattgccaaccaagctgtggtcctgatgggcttagataagggatggcccatctctaaaatggacctaggcgtgccgctgctcgcacttgggtgctactcacaggttaatccactgaccttgacagccgcggtgctgctcctggtaacccattacgctataattggacctggccttcaggccaaggcaactcgcgaggcccagaaaagaacggctgccggtatcatgaagaaccccacagtggatgggatcatgaccattgacttagatccagtcatctatgactccaagtttgagaaacaactgggacaggttatgctcttggtgctgtgtgcagtccagctactgctcatgaggacaagttgggctctttgcgaagccctgaccttggcgacaggccccataactaccctgtgggagggtagccctggcaagttctggaatacaacgattgccgtgtcgatggcaaacatctttcgggggtcttacctcgctggagccggcctggcattctccattatgaaaagcgtagggaccggacgaagaggcactggttcacagggggaaacattaggagagaagtggaaaaagaaacttaatcaactgagtcgcaaagaatttgatctctataagaaatctggcatcaccgaggtggacaggactgaggctaaggaaggtctaaaacggggcgagacaacccaccatgccgtttcccgtgggagcgccaagctgcagtggttcgtggaaagaaacatggtcataccggagggaagggtgatcgatttgggctgtgggcgcggaggctggtcatactattgcgcgggtctgaaaaaggtcacggaagtgcgggggtacaccaagggaggccccggccacgaggagccagttcctatgagtacatatgggtggaatattgtaaaactcatgagcggaaaggacgtgttctaccttccccctgaaaaatgtgatactctgttgtgcgacatcggtgagtcctctccaagccccaccgtcgaagagtcccgaacaattagagtgctgaagatggttgagccttggctcaaaaacaatcagttttgtatcaaggtgttaaacccatacatgcccactgtcattgaacacctggagaggcttcagcgcaagtatggcgggatgctggtgcggaatccgctatcaagaaactctacccatgaaatgtactggatcagtaatggaacaggcaacatagtatcgagcgtgaatatggtttcccgtctcctgttgaacaggttcaccatgactcaccggcgccctacgattgagaaagatgtcgacctgggtgctgggacacgacatgtgaacgcagaaccagagacccccaatatggacgtgatcggagagagaatcaagaggattaaagaggaacactcttcaacttggcactatgatgacgaaaacccttacaagacctgggcctatcatggcagctacgaggtcaaagctacaggctccgccagttctatgataaatggggttgtgaagctccttacgaagccatgggatgtagtgcccatggtcacccaaatggcaatgactgacacaaccccgtttggacagcagcgggtgttcaaagaaaaggttgatactcgcacacctagacccatgccaggtaccaggaaagtgatggagatcacagccgagtggctgtggcgaactttaggccggaacaagaaacctcgtctgtgcaccagagaagagtttacgaagaaggtccgcaccaatgctgcgatgggggccgtgttcacagaagagaaccaatgggacagcgcaagggctgccgtagaagatgaggagttttggaaattggttgaccgggaaagagagctccacaagctgggaaaatgtggctcatgcgtgtataatatgatgggtaagcgcgagaaaaagctaggggagttcggaaaagcaaagggctccagggccatttggtacatgtggcttggcgctcgatacctggagtttgaagccctcgggttcctgaacgaggatcattggtttagtcgggaaaatagctattctggagtcgagggtgaaggcttgcacaagctggggtacatcctcagagacatttccaaaatccccggaggcgcgatgtatgcagatgacactgccggttgggacaccaggataacagaggatgaccttcataacgaggaaaagatcactcagcagatggatccagagcaccgccagctggcttcagccattttcaaattaacctaccaaaataaggtggtgaaagtccagcgtcccacgcctaaggggacagttatggacatcattagccggaaggatcagagaggatcgggccaggtgggcacctatgggctgaacacttttacaaatatggaagcacaattggtaaggcagatggagggagaaggtgtgctctctaaagctgacctggagaacccacacctacttgagaagaaaatcacccagtggctggaaactaagggcgtcgagcgcctcaaacgaatggccataagtggggatgactgcgtggttaagccgattgatgaccggttcgctaatgccctgttggcattaaacgatatgggaaaggtgagaaaagacatcccccagtggcaaccttccaagggctggcatgattggcagcaggtcccattctgtagccaccattttcacgaactgatcatgaaagacggtaggaagctcgtggtaccctgccgccctcaggacgagcttattgggagagcgcggatatcacaaggagccggctggtccctgaaagaaaccgcttgtctaggcaaggcctacgcacagatgtggtctctgatgtatttccacaggcgtgatctccgattggctagcaacgccatctgcagtgcagttccagtgcattgggtccccacatcccgcacgacctggagcattcacgcccatcaccagtggatgactacagaggacatgctgaccgtgtggaatagagtttggatcgaggataacccttggatggaagacaagactccggtgacaacctgggaggatgtcccataccttgggaaacgggaagaccaatggtgtggatctctgattggtctcacgtcaagggcgacatgggctcagaatatcttaaccgccatacaacaggtgcgcagtctgatcggcgatgaggagtttttggactacatgccctccatgaagagattccggaaagaagaggaaagcgagggggcaatttggtga

SEQ ID NO: 15673 - RNA, 9873 nt, synthetic construct
  misc_feature 1..9873: note = derived and/or modified CDS sequence (opt3) from DENV-3__DQ675533__SS-prME
  source 1..9873: mol_type = other RNA
accagcctgtgcctcatgatgatccttcccgccgctctggctttccacttgacatccagggacggcgagcctaggatgattgtggggaagaacgaacggggaaaatctttactgtttaagactgcctcaggtataaatatgtgtacgctgatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccagacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcagctggccacacttaggaaactgtgtatcgagggaaagattaccaacatcacgaccgatagccggtgccctacacagggcgaagctgtcttgccagaggaacaggaccagaattatgtttgtaaacacacttacgtggatcgcggttgggggaacggatgcggcctcttcggcaaggggagtctggtaacctgcgccaagtttcaatgtttagagcccatagagggaaaagtggtccagtatgaaaatctgaagtacacagtgattatcactgttcataccggtgaccagcaccaggtgggcaacgagacacaaggggtcaccgcagaaattactcctcaggcttccacgcatgaggccctccttccagaatatggaacactgggcttggagtgctctccgcgaaccggtctagacttcaatgagatgatcctgctcactatgaaaaacaaggcgtggatggtgcacagacagtggtttttcgatctgccccttccttgggccagcggggcaaccacagaaaccccaacttggaataggaaagagctgttggtaacatttaagaacgctcacgccaaaaagcaagaagttgtggtcctcggctcccaggagggagctatgcatacggccctgaccggcgcaactgaaatccaaaattcagggggaacaagtattttcgccggtcacttaaagtgtcggctgaaaatggacaagctagagctcaaaggcatgagctacgctatgtgcaccaacacatttgtgctgaagaaagaggtctctgaaactcagcatgggaccatacttatcaaggtggagtacaagggagaagatgcgccctgtaaaattcctttctccacggaggacggccaaggtaaggcacacaacgggcgtttgatcaccgccaatccagttgtgactaagaaagaggaacccgtaaacatagaggctgaaccgcctttcggcgagtcaaatattgtcatcggaatcggcgataacgccctgaaaattaattggtataaaaaggggagcagtatcggaaaaatgtttgaagcaactgcccgcggtgctagaaggatggccattctcggcgacaccgcatgggatttcgggtctgtgggaggcgttctgaactcccttggtaagatggtgcatcagatatttgggagcgcgtacacagctctgttctcgggcgtctcttgggtgatgaaaatcggaattggcgtattgctcacttggatcgggctaaattccaagaacacctcaatgagttttagctgcatcgccattggaataatcacgttatatctgggcgcagtggttcaggccgacatgggttgtgtcattaattggaaagggaaggagctaaagtgcggatccggcatcttcgtgacaaacgaggtgcacacctggactgaacagtacaaatttcaagctgattctcccaagcggctcgccacagcaattgctggtgcctgggagaatggcgtctgtgggatccgaagcaccactcgcatggaaaacctgctttggaaacagatagcgaatgagttgaactatatcctgtgggaaaataacattaagctcaccgttgtggtgggagacacactgggcgtattagagcaggggaaaagaacgctgaccccacagcctatggagcttaagtactcatggaaaacttggggaaaggccaagatcgtcacagctgaaacccaaaacagttccttcattatcgatggccccaatacaccagagtgccccagcgcatctagggcctggaacgtgtgggaagttgaggactatggttttggggtgttcactaccaatatatggttgaaactccgggaagtctacacgcagctgtgtgaccaccgcctaatgtcagctgccgtgaaggatgagagagcagttcatgcggacatgggatactggattgagagtcagaaaaacggcagctggaagctggaaaaagcctccctcatcgaggtgaagacatgcacctggcctaagtctcacactctgtggtcgaatggtgtacttgaaagcgatatgattatcccaaaatccttggctggcccgatatcacagcataactataggcccgggtaccacacccaaacagccggaccttggcacctgggcaagttagagctcgactttaattattgcgaggggactaccgtcgtgatcacagaaagttgtggaacgcgtggcccatctctgcggaccactacagtgagcggtaaacttattcatgagtggtgctgtcgatcctgcaccctgccccctttgagatacatgggggaagatggatgttggtatggcatggagatcaggccaatttcagaaaaggaggagaacatggtcaaaagcctcgtttctgcaggttccggcaaggtggacaatttcactatgggggtactgtgcctagctatcctgtttgaagaggtgctccgcggaaagttcggcaaaaagcacatgatagccggggtcttctttacattcgtgctgcttttgagtggacagattacctggcgggatatggcacatacgctgatcatgatcggcagcaacgcctctgacagaatgggtatgggggttacttacttagctctcattgcgacctttaaaatccagcccttcctggcccttggatttttcctgaggaagctaacatcccgcgaaaatctcctgttgggcgtgggcctggcaatggctaccactttacaactcccggaggatattgaacagatggccaacgggatagccctgggacttatggctctgaaattgatcacacagtttgagacctatcagctctggacagcactggtctcactaacttgtagtaataccattttcacgctgacagtggcctggcgaaccgcgactcttatcctcgctggtgttagcctgttgcctgtgtgccaatcgtcctctatgcggaagaccgactggctgccaatgacagtcgccgcaatgggcgtaccccctttacccctcctgatttttagccttaaggatactctgaaacgtagatcatggccattgaacgagggggtgatggccgttggactcgtgagtatcctggcttcctctctactgaggaatgacgtccctatggcaggcccccttgtggccggtgggctcctgatagcgtgttacgtaatcaccggaacgagcgctgatttgacagtggaaaaggccgcagacgtcacctgggaggaagaggccgaacagactggcgtttcccacaacttaatgattacagtggacgatgacggcaccatgcgcatcaaagatgacgagactgagaacattctgacagtgctcctgaagaccgcccttctgatcgtctcagggatattcccatacagcattccggctacgttgctagtgtggcatacttggcagaaacagacccaacggagtggagttctgtgggatgtaccttctcccccagaaacacagaaggcagagctcgaagagggtgtgtatagaatcaaacagcagggcatctttgggaagacccaagtcggagtgggcgttcagaaggagggtgtgttccacacaatgtggcacgtcactagaggggctgtgctgacccataatggaaaacgacttgaacccaactgggcctccgtaaagaaagacttaattagctacggcggcgggtggcgcctgtcggcgcagtggcaaaagggagaggaagtccaggtgatagccgttgagcctggtaaaaatccaaagaactttcagacgatgcccggcacattccagactaccacaggggaaatcggagcaattgctctcgatttcaagcctggcacctcaggttctccgatcattaatcgggaggggaaagtggtcggattgtatggcaacggcgtggttactaagaatgggggatacgtgagtggtatcgcccaaaccaacgctgagccagacggccccacacctgaactggaggaagagatgtttaaaaagagaaatctcacgataatggatctgcacccagggtccggaaaaactaggaagtatcttcccgcaatcgtccgtgaagccattaagcgccggctgagaaccttgatcctagcccctacaagggtggtagctgcggagatggaggaagcactgaaaggcctcccgattcgataccagaccactgccacaaagagcgagcataccggtcgggaaatcgtggacttaatgtgccacgctacgttcactatgcgcctgctttctcccgttagagtcccaaactataatctgataattatggatgaggcccattttacagaccctgcaagcatcgccgctagggggtacatctccacccgggtgggaatgggcgaagcggccgcaattttcatgaccgctactcccccaggcacagccgatgcatttcctcagtcaaacgcccccatccaggacgaggagcgagacataccagaaagaagttggaatagcgggaacgagtggattaccgatttcgctggaaaaacagtgtggtttgtcccgtctatcaaggccggtaatgacattgcgaactgtctccgcaaaaacggcaagaaggtaatccaattgtccaggaaaactttcgatacggaataccagaagaccaaactgaatgactgggattttgtggttacaactgacatatcagagatgggggcaaacttcaaggccgatcgtgtgattgaccctcggagatgcctcaaacccgtcatcctgaccgatggaccagagagggtgatccttgctggccccatgcctgttacagccgctagtgcagcccagcgccgaggtagagtggggcggaatccacagaaggaaaacgaccaatatatttttaccggccagcccctaaataacgatgaggaccacgctcactggactgaagccaagatgctgttggacaatatcaacacgcctgagggaattataccggcattattcgaaccagagagggagaaaagcgcggccatcgatggcgaataccgcctgaagggggagtcccgtaaaaccttcgtcgaactcatgagacggggagacctgcccgtgtggcttgctcataaggtagcctctgagggtattaaatatacagataggaagtggtgctttgacggcgaacgcaataaccagatcctggaggagaatatggatgtggaaatctggactaaagagggggaacgaaagaagctcagacctcggtggttggacgcaaggacctactcggatcccctggctctaaaagagttcaaggactttgccgcaggacgcaaaagcattgccctggatctcgttacagaaataggcagagtcccatcacaccttgctcataggacccggaacgcgctggacaatttagtgatgttgcacacttccgagcacggtgggcgtgcctatcgccatgcagtggaggaactgcctgagacaatggaaacgctcctgcttctgggcctcatgatcttgctgaccggaggcgctatgttattcctaattagtgggaagggaatcggtaaaacttctattggcctgatctgtgtcatagccagctccgggatgctctggatggccgaggttccccttcagtggatcgcatcagctattgtgctggagtttttcatgatggtattgctgatcccagaacctgagaagcaacgaacaccgcaggataaccagctcgcctacgtggtcattggaatcctgacccttgcggctataattgccgcaaatgaaatgggcctcctggagaccacaaagagagacttgggtatgtctaaagaacccggggtggttagcccaacaagttatctggatgtggacttacaccctgcctccgcttggacgctatacgcagtcgccaccacagtaatcactcccatgctgaggcataccattgagaacagcacagcgaatgtgtctctcgctgccatcgcaaaccaagccgttgtgcttatgggcctggacaagggatggccaatatcaaaaatggatttgggcgtccctctgctcgctctggggtgctactcccaggtgaacccccttaccttaactgccgcagtcctgctcttgatcacgcactatgctattatcggaccgggcctgcaggccaaggcgacacgggaggcccagaaacgcaccgcagctggtattatgaagaatccaactgtggacgggatcatgaccatagatctagaccctgttatttacgatagtaagtttgaaaaacaactgggacaggtgatgctccttgtactgtgtgccgtgcagttgctgctcatgagaacaagctgggcactgtgcgaggctttaactcttgccaccggccccatcacaacgctgtgggaaggttcgccaggcaagttctggaacaccactatcgccgtctctatggcgaatatttttagggggtcctatctcgctggagcaggcctagccttcagcatcatgaaatcagttgggacaggaaagcggggcaccggtagtcagggggagactctgggagaaaaatggaagaagaaattgaaccaactgtctcgaaaggagtttgacctctacaaaaagtccggcataacagaggtggatagaaccgaagctaaagagggtcttaagcgcggcgaaacgacccatcacgccgtcagcagggggtcagcaaaactgcagtggttcgtggagcggaatatggtagtgcccgaaggacgtgttattgacttgggctgtgggagaggaggctggagttattactgcgccggtctgaagaaggtgacagaggtcagggggtatactaaaggaggccctggccacgaggaaccggtgcccatgagcacctacgggtggaacatcgtcaagctcatgtccggaaaagatgtgttttacttaccacctgagaagtgtgacacactgctttgcgatattggtgaatctagcccctcccctactgttgaggagtcacgcaccatccgggtactgaaaatggtggaaccatggctaaagaataaccagttctgtataaaggtcctcaatccctatatgcctacagtgatcgagcatctggaacgattgcagagaaaacacggcgggatgctggttaggaacccactctctcgcaatagtacccatgagatgtactggatttcgaacggaactggcaatatcgtgagctccgtcaacatggtgtctcggcttctgttaaatagattcacgatgacacaccgtaggcccaccattgaaaaggacgtagatctgggtgctgggactcggcacgtgaacgcggagccggagacccctaacatggacgttatcggagaacgcattaaacgaatcaaggaggaacataattcaacatggcactatgacgatgagaacccatacaaaacgtgggcctatcatggcagctacgaagtcaaggcaaccggctccgctagttctatgataaatggggtggtgaagttgctcactaaaccctgggacgtcgttcctatggtgacacaaatggccatgaccgatactacaccatttggacagcagagagtattcaaggagaaagtggacaccaggacaccccggccgatgcctggtactcgcaaggtcatggagattaccgcagaatggctgtggagaacgctaggcaggaacaaacgaccccggctttgcacccgtgaggaatttacaaagaaggtgagaactaatgccgctatgggggccgttttcaccgaggaaaaccaatgggatagcgcgaaagcagccgtggaggacgaggaattttggaagctggtcgatcgcgagagggaactccacaaactgggaaagtgtggctcatgcgtgtataatatgatgggtaaacgggagaagaaattgggggagttcggaaaggctaagggctccagagccatctggtacatgtggctgggcgcacgctacctcgaatttgaggctcttgggttcctgaacgaagaccattggtttagtagggagaatagctattctggagtagaaggtgagggcttacacaaactggggtacatcttgcgagatatttccaagataccaggaggcgccatgtatgctgacgatacagccggttgggacactcggatcaccgaggacgatctccacaacgaagagaaaattatccagcagatggaccctgaacatagacagctggcaaatgcgattttcaagctaacgtaccaaaacaaagttgtgaaggtccagaggcccacaccaaccgggactgtgatggatatcatatcacgcaaggaccagcgtggaagcggccaggtgggcacatatgggcttaatacctttactaacatggaggcccaactggtccggcagatggaaggagagggtgttctcaccaaagctgatctggagaatccccacttgttagaaaagaaaatcacacagtggctggagacgaagggcgtggaaagactcaaaaggatggccatttcgggggacgattgcgtagtgaagcctatcgacgatcgcttcgcaaacgcacttctggccctaaacgacatgggaaaggtccgaaaagatattccacagtggcaaccgtctaagggctggcatgactggcaacaggtgcccttttgtagtcaccacttccatgagctgatcatgaaagatggtcggaagctcgttgtgccttgcagaccacaggacgaattgatagggagggcacgcatttcccaaggagccggctggagcctgagagagaccgcgtgtcttggcaaggcttacgcccagatgtggtcactgatgtatttccaccggagggacctccgtttagcatccaatgccatctgctctgctgtccccgtgcattgggtacctactagccgaacaacctggagtatccacgcccatcaccagtggatgactacagaggatatgctgaccgtttggaaccgcgtgtggattgaagagaatccatggatggaagacaagacgcccgtcacaacctgggagaacgtgccttacttggggaagagagaggatcaatggtgtggatccctgataggtctcactagccgggcaacctgggctcagaatatcccgacagccattcagcaggttaggtctcttatcggcaacgaagagtttctggactacatgccatcaatgaaacgcttcagaaaggaagaggaaagtgagggggcgatttggtga

SEQ ID NO: 15674 - RNA, 9873 nt, synthetic construct
  misc_feature 1..9873: note = derived and/or modified CDS sequence (opt3) from DENV-3__AY744677__SS-prME
  source 1..9873: mol_type = other RNA
accagcctgtgcctcatgatgatgcttcccgccacactggctttccacttgacttcccgagacggagaacctaggatgatcgtggggaagaacgaacggggaaaatctttactgtttaagacggcatcaggtattaatatgtgtaccctgatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaaccgggacttcgttgaaggattgtcaggtgctacgtgggtggatgtcgtgctggagcatggcgggtgcgtgactacaatggccaagaataaacccaccctcgacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccagccaatggagctgaagtatagttggaagacttggggaaaagcgaagattgtaacagccgaaacccaaaattccagctttatcattgatggccctaacacacccgagtgcccatctgcttcaagagcatggaacgtctgggaagtggaggactacggtttcggggtttttactaccaatatctggcttaaattgagggaaatgtatacgcagctctgtgaccaccggctgatgagtgccgctgtgaaggatgagcgcgccgtccacgcagacatgggatactggatagagagccagaaaaacggctcctggaagctagaaaaggcgtctctgatcgaggtgaaaacatgcacctggcccaagtcgcatactctctggagcaatggtgttctggaatccgatatgattatccctaaatcacttgccggcccaattagtcagcacaactacagaccggggtatcatacccaaacagctggaccctggcacttgggcaagctggagttagacttcaattactgcgaggggactaccgtggtaatcacagaaaactgtggaacgaggggcccttctctccgtaccactacagtcagcggtaaactgatacacgagtggtgctgtcggtcctgcacccttccacccctgcgatatatgggggaagatggatgttggtacggcatggagattagacctatcaatgaaaaggaggagaacatggtgaagtcattggtgagcgccggttctggcaaagcagacaattttactatgggggtcctctgcctggctatcctattcgaagaggttatgaggggaaagttcggcaaaaagcatatgattgccggggcactgtttacattcgtgctcctgctttccggacagatcacctggcgcgatatggcccacacgttgattatgataggcagtaacgctagcgaccggatgggtatgggggtaacttatctggcgttaatcgccacctttaaaattcagccattcctcgcactgggatttttccttagaaagctgacatctagggaaaatctactcctgggcgtgggcttggctatggccaccactctgcaattacccgaggatatcgaacagatggccaacgggattgctctcggactgatggcacttaagctgatcacacagtttgagacctaccagttgtggacagccctcgtctccctgatgtgttcaaatactatattcaccctaacggtggcgtggcgcacagctaccctgatccttgccgttattagtctcctgccggtgtgccaaagctcgtccatgcgaaaaactgactggttgcctatgaccgtcgcagccatgggtgtgccacccctgcctttatttatcttctctctcaaggatacactgaaacggcgtagctggccccttaacgagggcgttatggctgtggggctggtctcaattttggcaagttcctttctcagaaatgacgtaccaatggccggacctctggtggcgggcggtctactgatcgcttgttatgttataactgggacctctgccgatcttacggtggaaaaggcagccgacgtcacatgggaggaagaggctgaacagaccggagtgagccataacctcatgattactgtagacgatgacggcacaatgaggatcaaagatgacgagaccgagaacatcctgactgtgttgttaaagacagccctgctcattgtctccggcatattcccctactcaatcccagcaaccctgcttgtttggcacacgtggcagaaacagactcaacgcagcggggtgctgtgggatgtgccgagtcctcccgaaacccagaaggctgagttggaagagggagtctaccggattaagcagcagggtatctttggcaaaacacaagtgggggttggagtacagaaggagggcgtgttccataccatgtggcacgtcacaagaggtgccgtgctaactcacaatgggaaaaggctggaaccaaactgggcgaatgttaagaaagacctcatttcttatggaggcggctggaagctgtccgcccagtggcaaaagggggaggaagtgcaggtcatcgcagtggagcccggcaagaaccctaagaatttccagaccatgccaggtatatttcagacgacaactggcgaaatcggggctattgcccttgatttcaaacccggaaccagcggctcgcctatcattaaccgagagggtaaggtagtcgggttatacggaaatggcgtggttaccaagaacggcgggtatgtgtcaggaatcgctcaaaccaatgcagagccggacggtccaactcccgaactggaggaagagatgtttaagaagcgcaacctcaccataatggatttgcatcctggctctgggaaaacacggaagtacctgccagccattgtcagagaagccatcaaaaggcgtctccgcacgctgatccttgctcccactcgggtggttgcggcagagatggaggaagccctgaagggattgcctattagatatcagaccacagctaccaaaagtgagcacactggcagggaaatcgtggacctaatgtgccatgccacattcaccatgcgactgctctccccggtccgggtgcccaattacaacttaatagtaatggatgaggcacactttacggacccagccagcattgctgcgcgcggttatatctctactagagtggggatgggagaagccgcagctattttcatgacagccacccctcccggcaccgcagatgcctttccacagagcaatgctcctatccaggacgaggagagggacatacccgaacggtcctggaactcaggcaatgagtggattactgatttcgccgggaagacagtttggtttgtcccaagtatcaaggcgggaaacgacatcgcaaactgtctgagaaagaatggtaagaaagtgattcaacttagcagaaagaccttcgatacagaataccagaaaactaagctgaacgactgggattttgtggtcacgaccgacatctctgagatgggcgccaatttcaaggctgatcgcgtaattgacccgaggcgttgcctcaaacctgtgatattgacagatgggcccgagcgggttatcctggccggaccaatgcccgtgactgtcgcttccgcagcccagagaaggggccgcgtgggtcgaaaccctcagaaggaaaatgaccaatacattttcaccgggcagccactcaacaatgatgaggaccatgctcactggacagaagccaaaatgctgcttgacaacatcaatacccccgagggcatcattcctgcactatttgaaccggagagagagaagtcagcggccatagatggagaatatcggctgaaaggcgagagtaggaagactttcgttgaattgatgcgccgtggggacttaccagtgtggctggctcacaaagtcgccagcgagggaatcaagtacacggatagaaagtggtgctttgacggtgaacggaacaatcagattctcgaggagaacatggatgtggaaatctggaccaaagagggcgaaaagaaaaagctgaggccccgctggcttgacgcacgaacatattccgatcctctggctctcaaagagttcaaggactttgccgcagggagaaagtctattgccttggatctggtaactgaaatcggacgggtgccctcgcatctagctcacaggacccgcaatgcgctggacaacctcgttatgcttcatacaagcgagcacggcggtagagcctacaggcacgcagtcgaggaactgccagagaccatggaaactttattgctgctcgggctgatgatacttctgacaggcggagctatgctattcttgatctcaggcaaagggattggaaagacgtccatcggtctgatttgtgtggtggccagttctggcatgttatggatggccgatgtccctctacagtggatcgcaagcgctatagttctggagtttttcatgatggtgctccttattcccgagccagaaaaacaacggacccctcaggacaatcagctggcctatgtagtgatcgggattttgactctggcggctatcgtcgccgcaaacgagatgggactcctggaaacaaccaagcgtgatcttggcatgtccaaagagccgggtgtggtttcacccacctcttacctcgacgtggacctgcatccagccagcgcttggacattgtatgcagtcgccactacggtaataacccctatgctgcgccacacaatcgaaaatagtactgcgaacgtgtccttagctgccattgcaaaccaagccgttgtgctaatggggctggataagggctggcccatcagcaagatggacctcggagtcccacttctggctttgggctgctactctcaggtgaatcctctgaccctcacagccgcagtcctgcttttagtgacccattacgctattatcgggcccggactgcaggccaaagcgactcgagaggcccagaagagaacggcagctggcataatgaaaaacccgacagttgatggtattatgaccatcgacctcgatccagtgatctatgactcaaagtttgagaaacaattggggcaggtaatgctgctagtgctgtgtgccgtccagctccttctgatgaggacttcctgggcattctgcgaggctttgaccctggccacaggacctattactaccctctgggaaggcagtcccggtaagttttggaatacaacgatcgccgttagcatggcgaacatattccggggctcgtacctggctggggcaggattagccttttctattatgaagtccgtgggcaccgggaaacgcggaactggcagccagggtgaaacacttggggagaagtggaaaaagagactgaatcaactctcaaggaaagagttcgatctatataagaaaagtggaatcaccgaggtcgaccggactgaggctaaggaaggcctgaagcgaggtgagattacacaccatgccgtgtctagaggctccgcaaaattgcagtggttcgtagaacgcaacatggtgatcccagaggggagggttatagatctgggatgtggcagagggggatggagctactattgcgccggcctcaagaaagtgaccgaagtccgtggttacacgaaagggggacccggccacgaggagcctgtgccgatgtcaacctatggctggaatatcgtcaaacttatgagtgggaaggacgtgttttacctgcccccagaaaagtgtgatacattgctgtgcgacattggagagagctccccttctcccactgttgaagagagcagaaccatcagggtactcaaaatggtggagccttggttaaagaacaatcagttctgtattaaagtcctgaacccatacatgcccacagtgatcgaacaccttgagcgcctgcagcggaagcatggtggcatgctagttcgaaatcctctctccagaaactcaactcacgaaatgtattggatttctaatgggaccggaaacatcgtgagttcggtcaatatggtgagcaggctgttgctgaaccgctttacaatgacccatcggagaccaactatagagaaagatgtagacctcggcgctggtacgcgtcacgtgaacgcggaacccgagacaccgaatatggacgttattggggagaggatccggcgcatcaaggaagaacactcctctacctggcattacgatgacgaaaacccttataagacttgggcctaccacggatcatatgaggtcaaagcaaccggcagcgcttccagtatgattaatggcgtggtgaaacttctgacaaaaccatgggatgtcgttcccatggtgacgcaaatggccatgaccgacactacacctttcgggcagcagcgagtatttaaggaaaaagtggataccagaactccaaggcccatgccgggaacacggaaggtcatggagataaccgcagagtggttatggcgcacactgggtagaaacaagaggcctcgattgtgcactcgggaagagttcatcaaaaaggtgcgtaccaatgccgctatgggcgccgtttttacggaagagaaccaatgggactctgcgagagcagccgtggaagatgaggagttctggaaactcgtcgaccgcgaaagggagctgcataagctagggaaatgtggaagctgcgtgtacaatatgatgggcaagcgggagaagaaacttggtgagtttgggaaggctaaaggatcaagagccatttggtatatgtggctgggcgcacgctacctcgagttcgaagctctgggctttttgaacgaggatcactggttctccagggaaaatagttacagcggggtagagggagaaggtctgcataagctcggctatatccttcgagacatttctaaaatccccgggggagccatgtacgctgatgacaccgccggctgggacacacggataactgaggatgacctgcacaacgaggaaaagatcacccagcagatggatccagagcacagacagttagcaaatgcgatttttaaactgacatatcaaaacaaggttgtgaaggtccagaggcctactcccaaaggtaccgtgatggacatcatttcccgcaaggatcagcgtgggtcaggacaggtgggcacgtacggcttgaatacattcaccaacatggaagcccaactcatccggcagatggagggggaaggagtcctgagcaaagctgacctagagaatccacatcttctggagaagaaagttactcagtggctcgaaacaaagggtgtggagagactgaagaggatggccatatcgggcgatgactgcgtagtgaaacccattgatgaccgcttcgcaaacgctttgttagccctgaacgatatggggaaggtccgaaaagacatccctcagtggcaaccatctaagggatggcacgattggcaacaggtgccgttttgtagtcatcacttccacgaactcatcatgaaagacggccggaaacttgttgtgccctgcagacctcaggacgagctgattggtagggcacgcatatcccaaggggccggatggagcctaagagaaaccgcgtgtctgggcaaggcttatgcccagatgtgggcactcatgtactttcatcggagggatttgcgtctggcctcaaatgctatctgctccgccgtcccagtgcactgggtacccacttctcgaaccacatggagcattcatgcacaccatcagtggatgacgaccgaggacatgcttactgtttggaaccgcgtgtggatcgaggataatccttggatggaagacaaaacaccagtcaccacttgggaggatgtgccctatctgggcaagagagaagaccaatggtgtgggagtctcattggattaacatcccgggctacctgggcccagaacatcctgacggcgatacagcaggttaggagcttgatcggtaatgaggagttcctggattacatgccttctatgaaacgctttagaaaggaagaggaatcagagggcgctatttggtga

SEQ ID NO: 15675 - RNA, 9873 nt, synthetic construct
  misc_feature 1..9873: note = derived and/or modified CDS sequence (opt3) from DENV-3__AY744678__SS-prME
  source 1..9873: mol_type = other RNA
accagcctgtgcctcatgatgatgcttcccgccacactggctttccacttgacttcccgagacggagaacctaggatgatcgtggggaaaaacgaacggggaaaatctttactgtttaagacggcatcaggtattaatatgtgtaccttaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagggacttcgttgaaggattgtcaggtgctacgtgggtggatgtcgtgctggagcatggcgggtgcgtgactacaatggccaagaataaacccaccctggacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctcctgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccagccaatggagctgaagtatagttggaagacttggggaaaagcgaagattgtaacagccgaaacccaaaattccagctttatcattgatggccctaacacacccgagtgcccatctgcttcaagagcatggaacgtctgggaagtggaggactacggtttcggggtttttactaccaatatctggcttaaattgagggaaatgtatacgcagctctgtgaccaccggctgatgagtgccgctgtgaaggatgagcgcgccgtccacgcagacatgggatactggatagagagccagaaaaacggctcctggaagctagaaaaggcgtctctgatcgaggtgaaaacatgcacctggcccaagtcgcatactctctggagcaatggtgttctggaatccgatatgattatccctaaatcacttgccggcccaattagtcagcacaactacagaccggggtatcatacccaaacagctggaccctggcacttgggcaagctggagttagacttcaattactgcgaggggactaccgtggtaatcacagaaaactgtggaacgaggggcccttctctccgtaccactacagtcagcggtaaactgatacacgagtggtgctgtcggtcctgcacccttccacccctgcgatatatgggggaagatggatgttggtacggcatggagattagacctatcaatgaaaaggaggagaacatggtgaagtcattggtgagcgccggttctggcaaagcagacaattttactatgggggtcctctgcctggctatcctattcgaagaggttatgaggggaaagttcggcaaaaagcatatgattgccggggcactgtttacattcgtgctcctgctttccggacagatcacctggcgcgatatggcccacacgttgattatgataggcagtaacgctagcgaccggatgggtatgggggtaacttatctggcgttaatcgccacctttaaaattcagccattcctcgcactgggatttttccttagaaagctgacatctagggaaaatctactcctgggcgtgggcttggctatggccaccactctgcaattacccgaggatatcgaacagatggccaacgggattgctctcggactgatggcacttaagctgatcacacagtttgagacctaccagttgtggacagccctcgtctccctgatgtgttcaaatactatattcaccctaacggtggcgtggcgcacagctaccctgatccttgccgttattagtctcctgccggtgtgccaaagctcgtccatgcgaaaaactgactggttgcctatgaccgtcgcagccatgggtgtgccacccctgcctttatttatcttctctctcaaggatacactgaaacggcgtagctggccccttaacgagggcgttatggctgtggggctggtctcaattttggcaagttcctttctcagaaatgacgtaccaatggccggacctctggtggcgggcggtctactgatcgcttgttatgttataactgggacctctgccgatcttacggtggaaaaggcagccgacgtcacatgggaggaagaggctgaacagaccggagtgagccataacctcatgattactgtagacgatgacggcacaatgaggatcaaagatgacgagaccgagaacatcctgactgtgttgttaaagacagccctgctcattgtctccggcatattcccctactcaatcccagcaaccctgcttgtttggcacacgtggcagaaacagactcaacgcagcggggtgctgtgggatgtgccgagtcctcccgaaacccagaaggctgagttggaagagggagtctaccggattaagcagcagggtatctttggcaaaacacaagtgggggttggagtacagaaggagggcgtgttccataccatgtggcacgtcacaagaggtgccgtgctaactcacaatgggaaaaggctggaaccaaactgggcgaatgttaagaaagacctcatttcttatggaggcggctggaagctgtccgcccagtggcaaaagggggaggaagtgcaggtcatcgcagtggagcccggcaagaaccctaagaatttccagaccatgccaggtatatttcagacgacaactggcgaaatcggggctattgcccttgatttcaaacccggaaccagcggctcgcctatcattaaccgagagggtaaggtagtcgggttatacggaaatggcgtggttaccaagaacggcgggtatgtgtcaggaatcgctcaaaccaatgcagagccggacggtccaactcccgaactggaggaagagatgtttaagaagcgcaacctcaccataatggatttgcatcctggctctgggaaaacacggaagtacctgccagccattgtcagagaagccatcaaaaggcgtctccgcacgctgatccttgctcccactcgggtggttgcggcagagatggaggaagccctgaagggattgcctattagatatcagaccacagctaccaaaagtgagcacactggcagggaaatcgtggacctaatgtgccatgccacattcaccatgcgactgctctccccggtccgggtgcccaattacaacttaatagtaatggatgaggcacactttacggacccagccagcattgctgcgcgcggttatatctctactagagtggggatgggagaagccgcagctattttcatgacagccacccctcccggcaccgcagatgcctttccacagagcaatgctcctatccaggacgaggagagggacatacccgaacggtcctggaactcaggcaatgagtggattactgatttcgccgggaagacagtttggtttgtcccaagtatcaaggcgggaaacgacatcgcaaactgtctgagaaagaatggtaagaaagtgattcaacttagcagaaagaccttcgatacagaataccagaaaactaagctgaacgactgggattttgtggtcacgaccgacatctctgagatgggcgccaatttcaaggctgatcgcgtaattgacccgaggcgttgcctcaaacctgtgatattgacagatgggcccgagcgggttatcctggccggaccaatgcccgtgactgtcgcttccgcagcccagagaaggggccgcgtgggtcgaaaccctcagaaggaaaatgaccaatacattttcaccgggcagccactcaacaatgatgaggaccatgctcactggacagaagccaaaatgctgcttgacaacatcaatacccccgagggcatcattcctgcactatttgaaccggagagagagaagtcagcggccatagatggagaatatcggctgaaaggcgagagtaggaagactttcgttgaattgatgcgccgtggggacttaccagtgtggctggctcacaaagtcgccagcgagggaatcaagtacacggatagaaagtggtgctttgacggtgaacggaacaatcagattctcgaggagaacatggatgtggaaatctggaccaaagagggcgaaaagaaaaagctgaggccccgctggcttgacgcacgaacatattccgatcctctggctctcaaagagttcaaggactttgccgcagggagaaagtctattgccttggatctggtaactgaaatcggacgggtgccctcgcatctagctcacaggacccgcaatgcgctggacaacctcgttatgcttcatacaagcgagcacggcggtagagcctacaggcacgcagtcgaggaactgccagagaccatggaaactttattgctgctcgggctgatgatacttctgacaggcggagctatgctattcttgatctcaggcaaagggattggaaagacgtccatcggtctgatttgtgtggtggccagttctggcatgttatggatggccgatgtccctctacagtggatcgcaagcgctatagttctggagtttttcatgatggtgctccttattcccgagccagaaaaacaacggacccctcaggacaatcagctggcctatgtagtgatcgggattttgactctggcggctatcgtcgccgcaaacgagatgggactcctggaaacaaccaagcgtgatcttggcatgtccaaagagccgggtgtggtttcacccacctcttacctcgacgtggacctgcatccagccagcgcttggacattgtatgcagtcgccactacggtaataacccctatgctgcgccacacaatcgaaaatagtactgcgaacgtgtccttagctgccattgcaaaccaagccgttgtgctaatggggctggataagggctggcccatcagcaagatggacctcggagtcccacttctggctttgggctgctactctcaggtgaatcctctgaccctcacagccgcagtcctgcttttagtgacccattacgctattatcgggcccggactgcaggccaaagcgactcgagaggcccagaagagaacggcagctggcataatgaaaaacccgacagttgatggtattatgaccatcgacctcgatccagtgatctatgactcaaagtttgagaaacaattggggcaggtaatgctgctagtgctgtgtgccgtccagctccttctgatgaggacttcctgggcattctgcgaagctctaaccctggccacaggacctattactaccctctgggagggcagtcccggtaagttttggaatacaacgatcgccgttagcatggcgaacatattccggggctcgtacctggctggggcaggattagccttttctattatgaagtccgtgggcaccgggaaacgcggaactggcagccagggtgaaacacttggggagaagtggaaaaagaaactgaatcaactctcaagaaaggagttcgatctatataaaaagagtggaatcaccgaggtcgacaggactgaggctaaggaaggcctgaaacggggtgagattacacaccatgccgtgtctcgaggctccgcaaagttgcagtggttcgtagaaagaaacatggtgatcccagaggggcgcgttatagatctgggatgtggcagagggggatggagctactattgcgccggcctcaaaaaggtgaccgaagtccggggttacacgaaagggggacccggccacgaggagcctgtgccgatgtcaacctatggctggaatatcgtcaaacttatgagtgggaaggacgtgttttacctgcccccagaaaaatgtgatacattgctgtgcgacattggagagagctccccttctcccactgttgaagagagccgtaccatcagagtactcaagatggtggagccttggttgaaaaacaatcagttctgtattaaggtcctgaacccatacatgcccacagtgatcgaacaccttgagaggctgcagcgcaaacatggtggcatgctagttcggaatcctctctcccgaaactcaactcacgaaatgtattggatttctaatgggaccggaaacatcgtgagttcggtcaatatggtgagcagactgttgctgaacaggtttacaatgacccatcgccggccaactatagagaaggatgtagacctcggcgctggtacgagacacgtgaacgcggaacccgagacaccgaatatggacgttattggggagcgtatcaggcggatcaaggaagaacactcctctacctggcattacgatgacgaaaacccttataaaacttgggcctaccacggatcatatgaggtcaaggcaaccggcagcgcttccagtatgattaatggcgtggtgaaacttctgacaaagccatgggatgtcgttcccatggtgacgcaaatggccatgaccgacactacacctttcgggcagcagcgcgtatttaaagaaaaggtggatacccgaactccaagacccatgccgggaacaaggaaggtcatggagataaccgcagagtggttatggcggacactgggtcgcaacaaaagacctaggttgtgcactcgagaagagttcatcaagaaagtgcggaccaatgccgctatgggcgccgtttttacggaagagaaccaatgggactctgcgcgtgcagccgtggaagatgaggagttctggaagctcgtcgacagagaacgcgagctgcataaactagggaagtgtggaagctgcgtgtacaatatgatgggcaaaagggaaaagaaacttggtgagtttgggaaagctaagggatcacgggccatttggtatatgtggctgggcgcaagatacctcgagttcgaagctctgggctttttgaacgaggatcactggttctcccgcgaaaatagttacagcggggtagagggagaaggtctgcataaactcggctatatccttagggacatttctaagatccccgggggagccatgtacgctgatgacaccgccggctgggacacacgaataactgaggatgacctgcacaacgaggagaaaatcacccagcagatggatccagagcaccggcagttagcaaatgcgatttttaagctgacatatcaaaacaaggttgtgaaagtccagagacctactcccaagggtaccgtgatggacatcatttccaggaaagatcagcgcgggtcaggacaggtgggcacgtacggcttgaatacattcaccaacatggaagcccaactcatccgtcagatggagggggaaggagtcctgagcaaggctgacctagagaatccacatcttctggagaaaaaggttactcagtggctcgaaacaaagggtgtggagcggctgaaaagaatggccatatcgggcgatgactgcgtagtgaagcccattgatgacaggttcgcatctgctttgttagccctgaacgatatggggaaagtccgcaaggacatccctcagtggcaaccaagtaaaggatggcacgattggcaacaggtgccgttttgttcccatcacttccacgaactcatcatgaaggacggccgaaaacttgttgtgccctgccggcctcaggacgagctgattggtagagcaaggataagccaaggggccggatggtcactacgcgaaaccgcgtgtctgggcaaggcttatgcccagatgtgggcactcatgtactttcatagacgggatttgaggctggcctccaacgctatctgctctgccgtcccagtgcactgggtacccactagccgtaccacatggagtattcatgcacaccatcagtggatgacgaccgaggacatgcttactgtttggaatcgagtgtggatcgaggataacccttggatggaagacaagacaccagtcaccacttgggaggatgtgccctatctgggcaaacgcgaagaccaatggtgtgggtccctcattggattaacaagcagagctacctgggcccagaatatcctgacggcgatacagcaggttcggtctttgatcggtaacgaggagttcctggattacatgccttcaatgaagaggtttcgcaaagaagaggaaagtgagggcgctatttggtga

SEQ ID NO: 15676 - RNA, 9873 nt, synthetic construct
  misc_feature 1..9873: note = derived and/or modified CDS sequence (opt3) from DENV-3__AY744679__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggccccccacgtgggcatgggtttggataccagaacgcaaacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagtggtccagcacgaaaatctgaagtatactgtgataattaccgttcatacaggtgaccagcaccaggtgggcaacgagacccaaggggtcactgccgaaatcacgccccaggcatctacagtggaggctattctccctgaatacggaacccttggcctggagtgcagcccacgaactggtttggactttaatgagatgatcctactgaccatgaaaaacaaggcctggatggtacatagacagtggttctttgatctcccgctgccctggacatccggggcgaccactgaaacacctacgtggaataaaaaggagcttctggttaccttcaaaaacgcccacgcaaagaagcaagaagtggtcgtgttgggctcacaggagggagctatgcacactgccctcacaggcgctaccgaaatccagacaagtgggggaactagcatttttgccggtcatctgaaatgtaggttaaagatggacaaactggagctaaagggcatgtcttatgcaatgtgcctcaatgccttcgtcctgaaaaaggaggtgtccgaaacccagcacgggacgatacttatcaaggttgagtacaaaggagaagatgctccatgtaagattcccttctcaaccgaggacggccaaggtaaagcgcataacgggcggttgatcacagcaaaccctatagtgactaagaaagaggaaccagtaaatattgaggccgaacccccgtttggcgagagcaacatcgtcatcggaattggcgataaggctctgaagatcaattggtacaaaaaggggagttctattggaaaaatgttcgaagccaccgcacgtggtgcccgcagaatggctatactcggcgacacagcctgggattttgggtccgtgggaggcgttctgaacagccttggtaagatggtgcaccagatcttcgggtcggcatatactgcgctgttttctggcgtctcctggattatgaaaatcggaatcggcgtgttgctcacctggattgggctgaattcaaagaacacgagtatgagcttctcctgcatagtaatcggaattatcacattatacctgggcgctgtggttcaggccgacatgggttgtgtcattaattggaaggggcaggagctaaaatgcggatctggcatctttgtgaccaacgaggtgcatacttggacagaacaatataagttccaggcagatagccctaaaaggctcgccaccgctatagccggtgcatgggagaatggcgtctgtgggatccggtcaactacccgaatggaaaacctgctttggaagcagattgctaatgagttgaactacatcctgtgggaaaataacattaaactcacagttgtggtgggagacgtaatcggcgtcctggagcaggggaagcgcacgttaaccccccaaccaatggagctgaaatatagttggaagacttggggaaaggccaaaatagtgacagcggaaacccagaattccagctttattatcgatggccctaacacacccgagtgcccatctgcctcaagagcttggaacgtttgggaagtggaggactacggtttcggggtctttactaccaatatttggcttaagttgagggaaatgtatacgcagctctgtgaccaccggctgatgagtgcagccgtgaaagatgagcgcgctgttcacgccgacatgggatactggatcgagagccagaagaacggctcctggaaactagaaaaggcatctctgatagaggtgaagacatgcacctggcccaaatcgcatactctctggagcaatggtgtactggaatccgatatgatcattcctaagtcacttgcgggcccaatcagtcaacacaactacagaccggggtatcatacccagacagccggaccctggcacttgggcaaactggagttagacttcaattactgcgaggggactaccgtcgtgattacagaaaactgtggaacgaggggcccttctctccgtaccactacagtgagcggtaagctgatccacgagtggtgctgtcggtcctgcacccttccacccctgcgatatatgggggaagatggatgttggtacggcatggagataagacctattaatgaaaaagaggagaacatggtcaagtcattggttagcgctggttctggcaaggccgacaattttactatgggggtgctctgcctggcaatcctattcgaagaggtaatgaggggaaaattcggcaagaaacatatgatcgctggggccctgtttacattcgtgctcctgctttccggacagattacctggcgcgatatggcacacacgttgatcatgattggcagtaacgccagcgaccggatgggtatgggggtcacttatctggctttaatagcgacctttaagatccaaccattcctcgccctgggatttttccttagaaaactgacatctagggaaaatctactcctgggcgtgggcttggcaatggctaccactctgcagttacccgaggatattgaacagatggccaacgggatcgccctcggactgatggctcttaagctgattacacagtttgagacctaccaattgtggacagcactcgtttccctgatgtgttcaaatactatcttcaccctaacggtggcctggcgcacagcgaccctgatacttgctgtcatcagtctcctgccggtgtgccagagctcgtccatgcgaaagactgactggttgcctatgaccgttgccgcaatgggtgtgccacccctgcctttatttattttctctctcaaagatacactgaagcggcgtagctggccccttaacgagggcgtcatggccgtagggctggtgtcaatcttggctagttcctttctcagaaatgacgttccaatggcaggacctctggtggccggcggtctactgattgcgtgttatgtcatcactgggacctctgctgatcttacggtggaaaaagccgcagacgtaacatgggaggaagaggccgaacagaccggagtgagccataacctcatgataactgtcgacgatgacggcacaatgaggattaaggatgacgagaccgagaacatcctgactgttttgttaaaaacagctctgctcatcgtgtccggcattttcccctactcaataccagccaccctgcttgtgtggcacacgtggcagaagcaaactcagcgcagcggggtcctgtgggatgtgccgagtcctcccgaaacccagaaagcagagttggaagagggagtttaccggatcaagcagcaaggtatttttggcaagacacaggtaggggtgggagtccagaaagagggcgtgttccataccatgtggcacgttacaagaggtgctgtgctaactcacaatgggaagaggctggaaccaaactgggccaatgtcaaaaaggacctcatctcttatggaggcggctggaaactgtccgcgcaatggcagaagggggaggaagtgcaggtaattgccgtcgagcccggaaagaaccctaaaaatttccagaccatgccaggtatctttcaaacgacaactggcgaaataggggcaatcgctcttgatttcaagcccggaaccagcggctcgcctattatcaaccgagagggtaaagtggttgggttatacggaaatggcgtggtcacaaagaacggcgggtatgtgtcaggaattgcccagaccaatgctgagccggacggtccaactcccgaactggaggaagagatgtttaaaaagcgcaacctcaccatcatggatttgcatcctggctctgggaagacacggaaatacctgccagcaatagttagagaagccattaagaggcgtctccgcacgctgatccttgcccccactcgggtggtcgctgcggagatggaggaagcactgaaaggattgcctatcagatatcagaccacagccaccaagagtgagcacactggcagggaaattgtggacctaatgtgccatgctacattcaccatgcgactgctctccccggtacgggtgcccaattacaacttaatcgttatggatgaggcccactttacggacccagcaagcatagccgctcgcggttatatttctactagagtcgggatgggagaagcggccgcaatcttcatgacagctacccctcccggcaccgccgatgcatttccacagagcaatgcccctattcaagacgaggagagggacatccccgaacggtcctggaactcaggcaatgagtggataactgatttcgctgggaaaacagtgtggtttgtgccaagtattaaggccggaaacgacatcgcgaactgtctgcgaaagaatggtaaaaaggtcatccagcttagcagaaaaaccttcgatacagaataccagaagactaaactgaacgactgggattttgtagtgacgaccgacatttctgagatgggcgcaaatttcaaggccgatcgcgttatcgacccgaggcgttgcctcaagcctgtgattttgacagatgggcccgagcgggtcatactggctggaccaatgcccgtgactgttgcctccgctgcacagagaaggggccgcgtgggtcgaaaccctcaaaaagaaaatgaccagtacatcttcaccgggcagccactcaacaatgatgaggaccatgcccactggacagaagctaagatgctgcttgacaacattaatacccccgagggcatcatccctgccctatttgaaccggagagagagaaatcagcagcgattgatggagaatatcggctgaagggcgagagtaggaaaactttcgtcgaattgatgcgccgtggggacttaccagtgtggctggcccacaaggtagctagcgagggaataaaatacacggatagaaagtggtgctttgacggtgaacggaacaatcagatcctcgaggagaacatggatgtggaaatttggaccaaggagggcgaaaaaaagaaactgaggccccgctggcttgacgcccgaacatattccgatcctctggcactcaaggagttcaaagactttgctgccgggagaaagtctatcgcattggatctggttactgaaattggacgggtcccctcgcatctagcccacaggacccgcaatgctctggacaacctcgtgatgcttcatacaagcgagcacggcggtagagcgtacaggcacgccgtggaggaactgccagagaccatggaaactttattgctgctcgggctgatgatccttctgacaggcggagcaatgctcttcttgatatcaggcaaggggatcggaaaaacgtccattggtctgatctgtgtcgttgctagttctggcatgttatggatggccgatgtgcctctacaatggattgccagcgcaatcgtactggagtttttcatgatggtgctccttatacccgagccagaaaagcagcggacccctcaggacaatcaactggcttatgtcgtgattgggatcttgactctggccgcgattgttgctgccaacgagatgggactcctggaaacaaccaaacgtgatcttggcatgtccaaggagccgggtgtggtctcacccacctcttacctcgacgtagacctgcatccagcaagcgcctggacattgtatgctgtggcaactacggttatcacccctatgctgcgccacacaatagaaaatagtactgccaacgtgtccttagcggctatcgccaaccaggcagtcgtgctaatggggctggataaaggctggcccattagcaagatggacctcggagtcccacttctggccttgggctgctactctcaggtgaatcctctgaccctcacagctgccgttctgcttttagtgacccattacgcaatcattgggcccggactgcaggctaaggccactcgagaggcgcaaaaaagaacggccgcaggcatcatgaagaacccgacagtagatggtataatgaccattgacctcgatccagtgatctatgactcaaaatttgagaagcagttggggcaggtcatgctgctagttctgtgtgctgtgcagctccttctgatgaggacttcctgggccttctgcgaagcattgaccctggctacaggacctatcactaccctctgggagggcagtcccggtaaattttggaatacaacgattgccgtcagcatggccaacatcttccggggctcgtacctggcgggggctggattagcattttctataatgaagtccgtgggcaccgggaagcgcggaactggcagccaaggtgaaacacttggggagaaatggaagaaaaagctgaatcagctctcaagaaaagaattcgatctatataagaaaagtggaattaccgaggtagacaggactgaggccaaggaaggcctgaagcggggtgagatcacacaccatgctgtgtctcgaggctccgccaaattgcagtggttcgttgaaagaaacatggtgattccagaggggcgcgtcatcgatctgggatgtggcagggggggatggagctactattgcgcaggcctcaagaaagtgaccgaagtccggggttacacgaaggggggacccggccacgaggagcctgtgccgatgtcaacctatggctggaatatagttaaacttatgagtgggaaggacgtattttacctgcccccagaaaagtgtgatacattgctgtgcgacatcggagagagctccccttctcccactgtggaagagagccgtaccattagagtcctcaaaatggtggagccttggttaaagaacaatcagttctgtatcaaagttctgaacccatacatgcccacagtgattgaacaccttgagaggctgcaacgcaagcatggtggcatgctagtccggaatcctctctcccgaaactcaactcacgaaatgtattggatctctaatgggaccggaaacattgtgagttcggtaaatatggtgagcagactgttgctgaacaggtttacaatgacccatcgccggccaactatcgagaaagatgttgacctcggcgccggtacgagacacgtcaacgctgaacccgagacaccgaatatggacataattggggagcgtatcaggcggatcaaggaagagcactcctctacctggcattacgatgacgaaaacccttataagacttgggcgtaccacggatcatatgaggtgaaagccaccggcagcgcatccagtatgattaatggcgtggtcaagcttctgacaaaaccatgggatgttgtgcccatggtaacgcagatggctatgaccgacactacacctttcgggcagcaacgcgtgtttaaggaaaaagtcgatacccgaactccaagacccatgccgggaacaaggaaggtgatggagataaccgccgagtggttatggcggacactgggtcgcaacaagagacctaggttgtgcactcgagaagagttcatgaaaaaggttcggaccaatgcagccatgggcgctgtgtttacggaagagaaccagtgggactctgcccgtgcggcagtcgaagatgaggagttctggaaactcgtggacagagaacgcgagctgcataagctagggaaatgtggaagctgcgtatacaatatgatgggcaagagggaaaaaaagcttggtgagtttgggaaggccaaaggatcacgggctatctggtatatgtggctgggcgccagatacctcgagttcgaagcactgggctttttgaacgaggatcactggttctcccgcgaaaatagttacagcggggttgagggagaaggtctgcataagctcggctatattcttagggacatctctaaaattcccgggggagctatgtacgccgatgacaccgctggctgggacacacgaatcactgaggatgacctgcacaacgaggaaaagataacccagcagatggatccagagcaccggcaattagccaatgcaatctttaaactgacatatcagaacaaggtggtcaaggtgcagagacctactcccaaaggtaccgtgatggacattatctccaggaaggatcagcgcgggtcaggacaagtcggcacgtacggcttgaatacattcaccaacatggaagcgcagctcattcgtcagatggagggggaaggagttctgagcaaagccgacctagagaatccacatcttctggagaagaaagtgactcagtggctcgaaacaaagggtgtagagcggctgaagagaatggctatctcgggcgatgactgcgtggtcaaacccatagatgacaggttcgccaacgcattgttagctctgaacgatatggggaaggtgcgcaaagacattcctcaatggcagccatctaagggatggcacgattggcagcaggttccgttttgtagtcatcacttccacgaactcatcatgaaagacggccgaaagcttgtggtcccctgccggcctcaagacgagctgatcggtagagccaggatttcccagggggcaggatggagcctacgcgaaaccgcctgtctgggcaaggcgtatgctcagatgtgggccctcatgtactttcatagacgggatttgaggctggcatcaaatgccatatgctccgctgtgccagtacactgggttcccacttctcgtaccacatggagcatccatgcccaccatcaatggatgacgaccgaggacatgcttactgtgtggaaccgagtctggattgaggataatccttggatggaagacaaaacaccagtgagtacctgggaggatgttccctatctgggcaagcgcgaagaccagtggtgtgggtccctcatcggattaactagcagagcaacatgggctcagaacattctgaccgccatccagcaagtgcggtctttgataggtaatgaggagttcctggattacatgccttcaatgaaaaggtttcgcaaggaagaggaaagtgagggcgcgatctggtga

SEQ ID NO: 15677 - RNA, 9873 nt, synthetic construct
  misc_feature 1..9873: note = derived and/or modified CDS sequence (opt3) from DENV-3__AY744680__SS-prME
  source 1..9873: mol_type = other RNA
accagcctgtgcctcatgatgatgcttcccgccacactggctttccacttgacttcccgagacggagaacctaggatgatcgtggggaaaaacgaacggggaaaatctttactgtttaagacggcatcaggtattaatatgtgtaccttaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagggacttcgttgaaggattgtcaggtgctacgtgggtggatgtcgtgctggagcatggcgggtgcgtgactacaatggccaagaataaacccaccctggacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctcctgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccagccaatggagctgaagtatagttggaagacttggggaaaagcgaagattgtaacagccgaaacccaaaattccagctttatcattgatggccctaacacacccgagtgcccatctgcttcaagagcatggaacgtctgggaagtggaggactacggtttcggggtttttactaccaatatctggcttaaattgagggaaatgtatacgcagctctgtgaccaccggctgatgagtgccgctgtgaaggatgagcgcgccgtccacgcagacatgggatactggatagagagccagaaaaacggctcctggaagctagaaaaggcgtctctgatcgaggtgaaaacatgcacctggcccaagtcgcatactctctggagcaatggtgttctggaatccgatatgattatccctaaatcacttgccggcccaattagtcagcacaactacagaccggggtatcatacccaaacagctggaccctggcacttgggcaagctggagttagacttcaattactgcgaggggactaccgtggtaatcacagaaaactgtggaacgaggggcccttctctccgtaccactacagtcagcggtaaactgatacacgagtggtgctgtcggtcctgcacccttccacccctgcgatatatgggggaagatggatgttggtacggcatggagattagacctatcaatgaaaaggaggagaacatggtgaagtcattggtgagcgccggttctggcaaagcagacaattttactatgggggtcctctgcctggctatcctattcgaagaggttatgaggggaaagttcggcaaaaagcatatgattgccggggcactgtttacattcgtgctcctgctttccggacagatcacctggcgcgatatggcccacacgttgattatgataggcagtaacgctagcgaccggatgggtatgggggtaacttatctggcgttaatcgccacctttaaaattcagccattcctcgcactgggatttttccttagaaagctgacatctagggaaaatctactcctgggcgtgggcttggctatggccaccactctgcaattacccgaggatatcgaacagatggccaacgggattgctctcggactgatggcacttaagctgatcacacagtttgagacctaccagttgtggacagccctcgtctccctgatgtgttcaaatactatattcaccctaacggtggcgtggcgcacagctaccctgatccttgccgttattagtctcctgccggtgtgccaaagctcgtccatgcgaaaaactgactggttgcctatgaccgtcgcagccatgggtgtgccacccctgcctttatttatcttctctctcaaggatacactgaaacggcgtagctggccccttaacgagggcgttatggctgtggggctggtctcaattttggcaagttcctttctcagaaatgacgtaccaatggccggacctctggtggcgggcggtctactgatcgcttgttatgttataactgggacctctgccgatcttacggtggaaaaggcagccgacgtcacatgggaggaagaggctgaacagaccggagtgagccataacctcatgattactgtagacgatgacggcacaatgaggatcaaagatgacgagaccgagaacatcctgactgtgttgttaaagacagccctgctcattgtctccggcatattcccctactcaatcccagcaaccctgcttgtttggcacacgtggcagaaacagactcaacgcagcggggtgctgtgggatgtgccgagtcctcccgaaacccagaaggctgagttggaagagggagtctaccggattaagcagcagggtatctttggcaaaacacaagtgggggttggagtacagaaggagggcgtgttccataccatgtggcacgtcacaagaggtgccgtgctaactcacaatgggaaaaggctggaaccaaactgggcgaatgttaagaaagacctcatttcttatggaggcggctggaagctgtccgcccagtggcaaaagggggaggaagtgcaggtcatcgcagtggagcccggcaagaaccctaagaatttccagaccatgccaggtatatttcagacgacaactggcgaaatcggggctattgcccttgatttcaaacccggaaccagcggctcgcctatcattaaccgagagggtaaggtagtcgggttatacggaaatggcgtggttaccaagaacggcgggtatgtgtcaggaatcgctcaaaccaatgcagagccggacggtccaactcccgaactggaggaagagatgtttaagaagcgcaacctcaccataatggatttgcatcctggctctgggaaaacacggaagtacctgccagccattgtcagagaagccatcaaaaggcgtctccgcacgctgatccttgctcccactcgggtggttgcggcagagatggaggaagccctgaagggattgcctattagatatcagaccacagctaccaaaagtgagcacactggcagggaaatcgtggacctaatgtgccatgccacattcaccatgcgactgctctccccggtccgggtgcccaattacaacttaatagtaatggatgaggcacactttacggacccagccagcattgctgcgcgcggttatatctctactagagtggggatgggagaagccgcagctattttcatgacagccacccctcccggcaccgcagatgcctttccacagagcaatgctcctatccaggacgaggagagggacatacccgaacggtcctggaactcaggcaatgagtggattactgatttcgccgggaagacagtttggtttgtcccaagtatcaaggcgggaaacgacatcgcaaactgtctgagaaagaatggtaagaaagtgattcaacttagcagaaagaccttcgatacagaataccagaaaactaagctgaacgactgggattttgtggtcacgaccgacatctctgagatgggcgccaatttcaaggctgatcgcgtaattgacccgaggcgttgcctcaaacctgtgatattgacagatgggcccgagcgggttatcctggccggaccaatgcccgtgactgtcgcttccgcagcccagagaaggggccgcgtgggtcgaaaccctcagaaggaaaatgaccaatacattttcaccgggcagccactcaacaatgatgaggaccatgctcactggacagaagccaaaatgctgcttgacaacatcaatacccccgagggcatcattcctgcactatttgaaccggagagagagaagtcagcggccatagatggagaatatcggctgaaaggcgagagtaggaagactttcgttgaattgatgcgccgtggggacttaccagtgtggctggctcacaaagtcgccagcgagggaatcaagtacacggatagaaagtggtgctttgacggtgaacggaacaatcagattctcgaggagaacatggatgtggaaatctggaccaaagagggcgaaaagaaaaagctgaggccccgctggcttgacgcacgaacatattccgatcctctggctctcaaagagttcaaggactttgccgcagggagaaagtctattgccttggatctggtaactgaaatcggacgggtgccctcgcatctagctcacaggacccgcaatgcgctggacaacctcgttatgcttcatacaagcgagcacggcggtagagcctacaggcacgcagtcgaggaactgccagagaccatggaaactttattgctgctcgggctgatgatacttctgacaggcggagctatgctattcttgatctcaggcaaagggattggaaagacgtccatcggtctgatttgtgtggtggccagttctggcatgttatggatggccgatgtccctctacagtggatcgcaagcgctatagttctggagtttttcatgatggtgctccttattcccgagccagaaaaacaacggacccctcaggacaatcagctggcctatgtagtgatcgggattttgactctggcggctatcgtcgccgcaaacgagatgggactcctggaaacaaccaagcgtgatcttggcatgtccaaagagccgggtgtggtttcacccacctcttacctcgacgtggacctgcatccagccagcgcttggacattgtatgcagtcgccactacggtaataacccctatgctgcgccacacaatcgaaaatagtactgcgaacgtgtccttagctgccattgcaaaccaagccgttgtgctaatggggctggataagggctggcccatcagcaagatggacctcggagtcccacttctggctttgggctgctactctcaggtgaatcctctgaccctcacagccgcagtcctgcttttagtgacccattacgctattatcgggcccggactgcaggccaaagcgactcgagaggcccagaagagaacggcagctggcataatgaaaaacccgacagttgatggtattatgaccatcgacctcgatccagtgatctatgactcaaagtttgagaaacaattggggcaggtaatgctgctagtgctgtgtgccgtccagctccttctgatgaggacttcctgggcattctgcgaagctctaaccctggccacaggacctattactaccctctgggagggcagtcccggtaagttttggaatacaacgatcgccgttagcatggcgaacatattccggggctcgtacctggctggggcaggattagccttttctattatgaagtccgtgggcaccgggaaacgcggaactggcagccagggtgaaacacttggggagaagtggaaaaagaaactgaatcaactctcaagaaaggagttcgatctatataaaaagagtggaatcaccgaggtcgacaggactgaggctaaggaaggcctgaaacggggtgagattacacaccatgccgtgtctcgaggctccgcaaagttgcagtggttcgtagaaagaaacatggtgatcccagaggggcgcgttatagatctgggatgtggcagagggggatggagctactattgcgccggcctcaaaaaggtgaccgaagtccggggttacacgaaagggggacccggccacgaggagcctgtgccgatgtcaacctatggctggaatatcgtcaaacttatgagtgggaaggacgtgttttacctgcccccagaaaaatgtgatacattgctgtgcgacattggagagagctccccttctcccactgttgaagagagccgtaccatcagagtactcaagatggtggagccttggttgaaaaacaatcagttctgtattaaggtcctgaacccatacatgcccacagtgatcgaacaccttgagaggctgcagcgcaaacatggtggcatgctagttcggaatcctctctcccgaaactcaactcacgaaatgtattggatttctaatgggaccggaaacatcgtgagttcggtcaatatggtgagcagactgttgctgaacaggtttacaatgacccatcgccggccaactatagagaaggatgtagacctcggcgctggtacgagacacgtgaacgcggaacccgagacaccgaatatggacgttattggggagcgtatcaggcggatcaaggaagaacactcctctacctggcattacgatgacgaaaacccttataaaacttgggcctaccacggatcatatgaggtcaaggcaaccggcagcgcttccagtatgattaatggcgtggtgaaacttctgacaaagccatgggatgtcgttcccatggtgacgcaaatggccatgaccgacactacacctttcgggcagcagcgcgtatttaaagaaaaggtggatacccgaactccaagacccatgccgggaacaaggaaggtcatggagataaccgcagagtggttatggcggacactgggtcgcaacaaaagacctaggttgtgcactcgagaagagttcatcaagaaagtgcggaccaatgccgctatgggcgccgtttttacggaagagaaccaatgggactctgcgcgtgcagccgtggaagatgaggagttctggaagctcgtcgacagagaacgcgagctgcataaactagggaagtgtggaagctgcgtgtacaatatgatgggcaaaagggaaaagaaacttggtgagtttgggaaagctaagggatcacgggccatttggtatatgtggctgggcgcaagatacctcgagttcgaagctctgggctttttgaacgaggatcactggttctcccgcgaaaatagttacagcggggtagagggagaaggtctgcataaactcggctatatccttagggacatttctaagatccccgggggagccatgtacgctgatgacaccgccggctgggacacacgaataactgaggatgacctgcacaacgaggagaaaatcacccagcagatggatccagagcaccggcagttagcaaatgcgatttttaagctgacatatcaaaacaaggttgtgaaagtccagagacctactcccaagggtaccgtgatggacatcatttccaggaaagatcagcgcgggtcaggacaggtgggcacgtacggcttgaatacattcaccaacatggaagcccaactcatccgtcagatggagggggaaggagtcctgagcaaggctgacctagagaatccacatcttctggagaaaaaggttactcagtggctcgaaacaaagggtgtggagcggctgaaaagaatggccatatcgggcgatgactgcgtagtgaagcccattgatgacaggttcgcaaacgctttgttagccctgaacgatatggggaaagtccgcaaggacatccctcagtggcaaccatctaaaggatggcacgattggcaacaggtgccgttttgtagtcatcacttccacgaactcatcatgaaggacggccgaaaacttgttgtgccctgccggcctcaggacgagctgattggtagagcaaggatatcccaaggggccggatggagcctacgcgaaaccgcgtgtctgggcaaggcttatgcccagatgtgggcactcatgtactttcatagacgggatttgaggctggcctcaaatgctatctgctccgccgtcccagtgcactgggtacccacttctcgtaccacatggagcattcatgcacaccatcagtggatgacgaccgaggacatgcttactgtttggaaccgagtgtggatcgaggataatccttggatggaagacaagacaccagtcaccacttgggaggatgtgccctatctgggcaaacgcgaagaccaatggtgtgggagtctcattggattaacatccagagctacctgggcccagaacatcctgacggcgatacagcaggttcggagcttgatcggtaatgaggagttcctggattacatgccttctatgaagaggtttcgcaaagaagaggaatcagagggcgctatttggtga

SEQ ID NO: 15678 - RNA, 9873 nt, synthetic construct
  misc_feature 1..9873: note = derived and/or modified CDS sequence (opt3) from DENV-3__AY744681__SS-prME
  source 1..9873: mol_type = other RNA
accagcctgtgcctcatgatgatgcttcccgccaccctggctttccacttgacttccagagacggcgaacctaggatgatcgtggggaagaacgaacggggaaagtctttactgtttaagacggcatcaggtattaatatgtgtaccctgatagccatggatctcggcgaaatgtgcgacgatacagtcacttacaagtgtccactgatcaccgaagttgagccggaagacattgattgctggtgtaaccttacaagtacctgggtgacttatgggacatgcaatcaggcgggagagcatcgccgagacaagcgtagcgtggctctggcaccccacgtgggcatgggtttggatacccggacgcaaacttggatgtccgcagagggggcctggaggcaggtcgaaaaggtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataaacccaccctcgacatcgagctccagaagactgaagcgacacaactggcaacccttaggaaactgtgtattgagggacggatcacgaacgtcaccacagatagccgctgccctactcagggcgaagccattttgccagaggaacaggaccagaattatgtttgtaagcacacctacgtggatcgaggttgggggaacggatgcggcctctttggcaaagggagtctggtaacatgcgctaagttccaatgtttagagtccatcgagggaaaggccgtgcagcacgaaaatctgaaatatactgtcataattaccgtgcatacaggtgaccagcaccaggttggctctgagacccaaggggtgactgcagaaatcacgccccaggctagcacagtcgaggccattctccctgaatacggaacccttggcctggagtgctccccaagaactggtttggactttaacgagatgatcctactgaccatgaagaataaagcgtggatggtgcataggcagtggttctttgatctcccgctgccctggacatcaggggccaccactgaaacacctacgtggaacaagaaagagcttctggtaaccttcaagaatgcacacgctaaaaagcaagaagttgtggtcttgggcagtcaggagggagccatgcacactgctctcacaggcgccaccgaaatccagacaagcgggggaacttctatttttgcaggtcatctgaagtgtcggttaaaaatggacaagctggagctaaaaggcatgtcctatgccatgtgcctcaacgctttcgtgctgaagaaagaggtctcagaaacccagcacgggacgatacttatcaaggtggagtacaagggagaagatgcgccatgtaaaattcccttcagcaccgaggacggccaaggtaaggcacataatgggcgtttgatcacagccaaccctatagttactaaaaaggaggaaccagtgaacattgaggctgaacccccgtttggcgagagtaatatcgtaatcggaattggcgataaagccctgaagatcaactggtacaagaaagggtcttccattggaaagatgttcgaagcaaccgcccgcggtgctagaaggatggccatactcggcgacacagcatgggattttgggagcgtcggaggcgtgctaaattcgcttggtaaaatggttcaccagatcttcgggtctgcgtatactgctctgttttccggcgtgtcatggattatgaagatcggaatcggcgtcttgctcacctggattgggctgaacagtaaaaatacgagcatgtccttctcttgcatagtgatcggaattatcacattatacctgggcgccgtagtgcaggcagacatgggttgtgttattaactggaaggggaaggagctaaaatgcggaagcggcatctttgtcaccaatgaggtgcatacttggacagaacagtataagttccaagccgattcacctaaacggctcgctaccgccatagccggtgcttgggagaacggcgtgtgtgggatccgaagtactacccgcatggaaaatctgctttggaagcagattgccaacgagttgaattacatcctgtgggaaaacaatattaaactcacaatcgtcgttggagacgtgataggcgtgctggagcaggggaagagaacgttaacaccccagccaatggagctgaaatattcctggaagacttggggaaaggcgaaaattgtaacagccgaaacccaaaacagctcttttatcattgatggccctaatacacccgagtgcccatcagctagtagggcatggaacgtctgggaagtggaggactacggtttcggggtttttactaccaacatctggcttaagttgcgggaaatgtatacgcagctctgtgaccaccgcctgatgagcgccgctgtgaaagatgagagagccgtccacgcagacatgggatactggatagagtcccagaagaatggctcttggaaactagaaaaggcgtcgctgatcgaggtgaagacatgcacctggcccaaaagccatactctctggtccaacggtgttctggaatcagatatgattatccctaagagtcttgccggcccaatttctcagcacaattacaggccggggtatcatacccaaacagctggaccctggcacttgggcaaactggagttagacttcaactactgcgaggggactaccgtggtaatcacagaaaattgtggaacgcgtggccctagcctccggaccactacagtctccggtaagctgatacacgagtggtgctgtcgatcatgcacccttccacccctgagatatatgggggaagatggatgttggtacggcatggagattaggcctatcaacgaaaaagaggagaatatggtaaagagcttggtgtctgccggttccggcaaggcagacaactttactatgggggtcctctgcctggctatcctattcgaagaggttatgcgcggaaaattcggcaagaaacatatgattgccggggcactgtttacattcgtgctcctgcttagtggacagatcacctggcgggatatggcccacacgttgattatgataggcagcaatgcttctgacagaatgggtatgggggtaacttatctggcgttaatcgccacctttaagattcagccattcctcgcactgggatttttccttaggaaactgacatcccgcgaaaacctactcctgggcgtgggcttggctatggccaccactctgcaattacccgaggatatcgaacagatggccaatgggattgctctcggactgatggcacttaagctgatcacacagtttgagacctaccagttgtggacagccctcgtctcactgatgtgtagtaacactatattcaccctaacggtggcgtggcgaacagctaccctgatccttgccgttattagcctcctgccggtgtgccaatcgtcctctatgcggaagactgactggttgcctatgaccgtcgcagccatgggtgtgccacccctgcctttatttatcttcagcctcaaagatacactgaagcgtagatcatggccccttaatgagggcgttatggctgtggggctggtcagtattttggcatcctcttttctcaggaacgacgtaccaatggccggacctctggtggcgggcggtctactgatcgcttgttatgttataactgggaccagcgccgatcttacggtggaaaaagcagccgacgtcacatgggaggaagaggctgaacagaccggagtgtcccataatctcatgattactgtagacgatgacggcacaatgcgcatcaaggatgacgagaccgagaacatcctgactgtgttgttaaaaacagccctgctcattgtctcaggcatattcccctacagcatcccagcaaccctgcttgtttggcacacgtggcagaagcagactcaacggagtggggtgctgtgggatgtgccgtctcctcccgaaacccagaaagctgagttggaagagggagtctacagaattaagcagcagggtatctttggcaagacacaagtgggggttggagtacagaaagagggcgtgttccataccatgtggcacgtcacaaggggtgccgtgctaactcacaacgggaagcgactggaaccaaattgggcgaacgttaaaaaggacctcatttcctatggaggcggctggaaactgagcgcccagtggcaaaagggggaggaagtgcaggtcatcgcagtggagcccggaaagaatcctaaaaacttccagaccatgccaggtatatttcagacgacaactggcgaaatcggggctattgcccttgatttcaagcccggaacctcgggctcacctatcattaatcgcgagggtaaagtagtcgggttatacggaaacggcgtggttacaaagaatggcgggtatgtgtctggaatcgctcaaaccaacgcagagccggacggtccaactcccgaactggaggaagagatgtttaaaaagcggaatctcaccataatggatttgcatcctggcagtgggaagacaagaaaatacctgccagccattgtcagggaagccatcaagcgtcgcctccggacgctgatccttgctcccactagagtggttgcggcagagatggaggaagccctgaaaggattgcctattaggtatcagaccacagctaccaagtccgagcacactggccgagaaatcgtggacctaatgtgccatgccacattcaccatgcggctgctcagcccggtccgcgtgcccaactacaatttaatagtaatggatgaggcacactttacggacccagcctctattgctgcgagaggttatatcagcactagggtggggatgggagaagccgcagctattttcatgacagccacccctcccggcaccgcagatgcctttccacagtccaacgctcctatccaggacgaggagcgggacatacccgaacgatcatggaatagtggcaacgagtggattactgatttcgccgggaaaacagtttggtttgtcccaagcatcaaggcgggaaatgacatcgcaaactgtctgagaaagaacggtaaaaaggtgattcaactttctcgcaaaaccttcgatacagaataccagaagactaaactgaatgactgggattttgtggtcacgaccgacatctccgagatgggcgccaacttcaaggctgatagggtaattgacccgcgtcggtgcctcaagcctgtgatattgacagatgggcccgagagagttatcctggccggaccaatgcccgtgactgtcgcttcagcagcccagaggcgcggccgagtgggtagaaatcctcagaaagaaaacgaccaatacattttcaccgggcagccactcaataacgatgaggaccatgctcactggacagaagccaagatgctgcttgacaatatcaacacccccgagggcatcattcctgcactatttgaaccggagcgggagaaaagtgcggccatagatggagaatataggctgaagggcgagagccgcaaaactttcgttgaattgatgcgtagaggggacttaccagtgtggctggctcacaaggtcgcctccgagggaatcaaatacacggatcggaagtggtgctttgacggtgaaaggaataaccagattctcgaggagaatatggatgtggaaatctggaccaaggagggcgagaagaagaaactgcgcccccgatggcttgacgcaagaacatattctgatcctctggctctcaaggagttcaaagactttgccgcagggcggaagtcgattgccttggatctggtaactgaaatcggaagggtgcccagccatctagctcaccgcaccagaaacgcgctggacaatctcgttatgcttcatacatcagagcacggcggtagggcctaccggcacgcagtcgaggaactgccagagaccatggaaactttattgctgctcgggctgatgatacttctgacaggcggagctatgctattcttgatctccggcaaggggattggaaaaacgagtatcggtctgatttgtgtggtggcctctagcggcatgttatggatggccgatgtccctctacagtggatcgcatccgctatagttctggagtttttcatgatggtgctccttattcccgagccagaaaagcaacgtacccctcaggacaaccagctggcctatgtagtgatcgggattttgactctggcggctatcgtcgccgcaaatgagatgggactcctggaaacaaccaaacgcgatcttggcatgtcaaaggagccgggtgtggtttctcccaccagctacctcgacgtggacctgcatccagccagtgcttggacattgtatgcagtcgccactacggtaataacccctatgctgcgacacacaatcgaaaactccactgcgaatgtgagcttagctgccattgcaaaccaagccgttgtgctaatggggctggataaaggctggcccatctctaagatggacctcggagtcccacttctggctttgggctgctactcacaggtgaaccctctgaccctcacagccgcagtcctgcttttagtgacccattacgctattatcgggcccggactgcaggccaaggcgactagagaggcccagaaaaggacggcagctggcataatgaagaatccgacagttgatggtattatgaccatcgacctcgatccagtgatctatgactccaaatttgagaagcaattggggcaggtaatgctgctagtgctgtgtgccgtccagctccttctgatgcggaccagttgggcattctgcgaggctttgactctggccacaggacctattactaccctctgggaaggcagccccggtaaattttggaacacaacgatcgccgtttcgatggcgaatatattccgcggctcttacctggctggggcaggattagccttttccattatgaaaagcgtgggcaccgggaagagaggaactggctcacagggtgaaacacttggggagaaatggaagaaaaagctgaaccaactcagtaggaaagagttcgatctatataagaaatctggaatcaccgaggtcgaccggactgaggctaaggaaggcctgaagcgaggtgagattacacaccatgccgtgtccagaggcagcgcaaaattgcagtggttcgtagaacgcaatatggtgatcccagaggggagggttatagatctgggatgtggcagagggggatggtcatactattgcgccggcctcaagaaagtgaccgaagtccgtggttacacgaaagggggacccggccacgaggagcctgtgccgatgagtacctatggctggaacatcgtcaaacttatgagcgggaaggacgtgttttacctgcccccagaaaagtgtgatacattgctgtgcgacattggagagtcctctcctagccccactgttgaagagtccagaaccatcagggtactcaaaatggtggagccttggttaaagaataaccagttctgtattaaagtcctgaatccatacatgcccacagtgatcgaacaccttgagcgcctgcagcggaagcatggtggcatgctagttcgaaaccctctctcaagaaattctactcacgaaatgtattggattagtaacgggaccggaaatatcgtgtcgagcgtcaacatggtgtccaggctgttgctgaatcgctttacaatgacccatcggagaccaactatagagaaagatgtagacctcggcgctggtacgcgtcacgtgaacgcggaacccgagacaccgaacatggacgttattggggagaggatccggcgcatcaaggaagaacactcttcaacctggcattacgatgacgaaaatccttataagacttgggcctaccacggaagctatgaggtcaaagcaaccggctccgctagttctatgattaacggcgtggtgaaacttctgacaaaaccatgggatgtcgttcccatggtgacgcaaatggccatgaccgacactacacctttcgggcagcagcgagtatttaaggaaaaagtggataccagaactccaaggcccatgccgggaacacggaaggtcatggagataaccgcagagtggttatggcgcacactgggtagaaataagaggcctcgattgtgcactcgggaagagttcatcaaaaaggtgcgtaccaacgccgctatgggcgccgtttttacggaagagaatcaatgggacagcgcgagagcagccgtggaagatgaggagttctggaaactcgtcgaccgcgaaagggagctgcataagctagggaaatgtggatcatgcgtgtacaacatgatgggcaagcgggagaagaaacttggtgagtttgggaaggctaaaggatccagagccatttggtatatgtggctgggcgcacgctacctcgagttcgaagctctgggctttttgaatgaggatcactggttcagtagggaaaacagctactctggggtagagggagaaggtctgcataagctcggctatatccttcgagacatttccaaaatccccgggggagccatgtacgctgatgacaccgccggctgggacacacggataactgaggatgacctgcacaatgaggaaaagatcacccagcagatggatccagagcacagaaggttagcaaacgcgatttttaaactgacatatcagaataaggttgtgaaggtccaacgccctactcccaaaggtaccgtgatggacatcatttcacgtaaggatcagcgggggagcggacaggtgggcacgtacggcttgaacacattcaccaatatggaagcccagctcatcagacaaatggagggggaaggagtcctgtcgaaagctgacctagagaacccacatcttctggagaagaaagttactcagtggctcgaaacaaagggtgtggagaggctgaagcgcatggccatatctggcgatgactgcgtagtgaaacccattgatgaccgattcgcaaatgctttgttagccctgaacgatatggggaaggtccggaaagacatccctcagtggcagccaagtaagggatggcacgattggcaacaggtgccgttttgttcccatcacttccacgaactcatcatgaaagacggcagaaaacttgttgtgccctgcaggcctcaggacgagctgattggtcgcgcaagaataagccagggggccggatggtcactacgggaaaccgcgtgtctgggcaaggcttatgcccaaatgtgggcactcatgtactttcataggcgtgatttgcgactggcctccaacgctatctgctctgccgtcccagtgcactgggtacccactagccgcaccacatggagtattcatgcacaccatcagtggatgacgaccgaggacatgcttactgtttggaatagagtgtggatcgaggataacccttggatggaagacaaaacaccagtcaccacttgggaggatgtgccctatctgggcaagcgggaagaccagtggtgtgggtccctcattggattaacaagcagggctacctgggcccaaaatatcctgacggcgatacagcaggttcgctctttgatcggtaacgaggagttcctggattacatgccttcaatgaaaagatttcggaaggaagaggaaagtgagggcgctatttggtga

SEQ ID NO: 15679 - RNA, 9873 nt, synthetic construct
  misc_feature 1..9873: note = derived and/or modified CDS sequence (opt3) from DENV-3__AY744682__SS-prME
  source 1..9873: mol_type = other RNA
accagcctgtgcctcatgatgatgcttcccgccactctggctttccacttgacttcccgagacggagaacctaggatgatcgtggggaagaacgaacggggaaaatctttactgtttaagacggcatcaggtattaatatgtgtaccttaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgttgctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagggacttcgttgaaggattgtcaggtgctacgtgggtggatgtcgtgctggagcatggcgggtgcgtgactacaatggccaagaataaacccaccctggacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcaccataacagtgcataccggtgaccagcaccaggttggcaacgagactcaaggggtgacggcagaaattacaccccaggcttctaccgtcgaggccatcctccctgaatacggaactcttggcctggagtgcagcccacgaaccggtttggactttaatgagatgattctcctgacaatgaaaaacaaggcgtggatggtgcatagacagtggttctttgatctcccgctgccctggacctccggggccactacagaaacgcctacctggaataaaaaggagcttctggtaactttcaaaaacgcacacgctaagaagcaagaagttgtggtcttgggctcacaggagggagccatgcacacagctctcaccggcgccacagaaatccagacaagtgggggaaccagcatctttgcaggtcatctgaaatgtaggttaaagatggacaaactggagctaaagggcatgtcttatgccatgtgcctcaatgctttcgtgctgaaaaaggaggtctccgaaacgcagcacgggaccattcttataaaggtggagtacaaaggagaagatgcgccatgtaagatccccttctcaacagaggacggccaaggtaaagcacataacgggcggttgattactgccaaccctatcgttaccaagaaagaggaaccagtgaatatagaggctgaacccccgtttggcgagagcaacattgtaatcggaatcggcgataaggccctgaagattaattggtacaaaaaggggagttctatcggaaaaatgttcgaagcaacagcccgtggtgctcgcagaatggccattctcggcgacactgcatgggattttgggtccgtcggaggcgtgctgaacagccttggtaagatggttcaccagatattcgggtcggcgtataccgctctgttttctggcgtgtcctggatcatgaaaattggaatcggcgtcttgctcacgtggatcgggctaaattcaaagaacacaagtatgagcttctcctgcattgtgataggaatcattaccttatacctgggcgccgtagtgcaggcagacatgggttgtgttatcaattggaaggggaaagagctaaagtgcggatctggcatttttgtcactaacgaggtgcatacatggaccgaacagtataaattccaagccgatagccctaagaggctcgctactgccatcgccggtgcttgggagaatggcgtgtgtgggatacggtcaaccacacgaatggaaaacctgctttggaaacagatcgccaatgagttgaactacattctgtgggaaaataacatcaagctcacgattgtcgttggagacgtgatcggcgtgctggagcaggggaaacgcaccttaactccccagccaatggagctgaagtatagttggaagacatggggaaaagcgaagatagtaaccgccgaaacacaaaattccagctttattatcgatggccctaacactcccgagtgcccatctgcttcaagagcatggaacgtctgggaagtggaggactacggtttcggggtttttaccacgaatatttggcttaaattgagggaagtgtatacacagctctgtgaccaccggctgatgagtgccgctgtcaaggatgagcgcgccgtgcacgcagacatgggatactggatcgagagccagaaaaacggctcctggaagctagaaaaggcgtctctgatagaggttaaaacctgcacttggcccaagtcgcataccctctggagcaatggtgtgctggaatccgatatgatcattcctaaatcacttgccggcccaatcagtcagcacaactacagaccggggtatcatacacaaactgctggaccctggcacttgggcaagctggagttagacttcaattactgcgaggggaccacagtagtcattacggaaaactgtggaaccaggggcccttctctccgtactacaaccgtgagcggtaaactgatccacgagtggtgctgtcggtcctgcactcttccacccctgcgatatatgggggaagatggatgttggtacggcatggagataagacctattaatgaaaaggaggagaacatggtgaagtcattggtcagcgccggttctggcaaagcagacaattttacaatgggggttctctgcctggctatcctattcgaagaggtgatgaggggaaagttcggcaaaaagcatatgatctccggggccctgtttaccttcgtactcctgcttagtggacagattacgtggcgcgatatggcacacactttgatcatgattggcagcaacgcctctgaccggatgggtatgggggtgacctatctggctttaatagcgacatttaaaatccagccattcctcgccctgggatttttccttagaaagctgacctccagggaaaatctactcctgggcgtcggcttggcaatggctactacactgcaattacccgaggatattgaacagatggccaacgggatcgccctcggactgatggctcttaagctgattacccagtttgagacataccagttgtggactgcactcgtgtcactgatgtgtagtaataccatcttcacgctaacagttgcctggcgcaccgcgactctgatacttgctgtgatcagcctcctgccggtctgccaatcgtcctctatgcgaaaaaccgactggttgcctatgacagtggccgcaatgggtgttccacccctgcctttatttattttcagcctcaaggatactctgaaacggcgttcatggccccttaacgagggcgtgatggccgtcgggctggtaagtatcttggcttcctcttttctcagaaatgacgtgccaatggcaggacctctggttgccggcggtctactgattgcgtgttatgtgatcaccgggacgagcgctgatcttacagtcgaaaaggccgcagacgtgacctgggaggaagaggccgaacagactggagtatcccataacctcatgataacagtggacgatgacggcaccatgaggattaaagatgacgagactgagaacatcctgacagtcttgttaaagaccgctctgctcatcgtttcaggcattttcccctacagcataccagccacgctgcttgtgtggcacacttggcagaaacagacccaacgcagtggggtgctgtgggatgtcccgtctcctcccgaaacacagaaggcagagttggaagagggagtgtaccggatcaagcagcagggtatttttggcaaaacccaagttggggtaggagtgcagaaggagggcgtcttccatacaatgtggcacgtgactagaggtgctgttctaacccacaatgggaaaaggctggaaccaaactgggccaatgtgaagaaagacctcatctcctatggaggcggctggaagctgagcgcgcagtggcaaaagggggaggaagtccaggtgattgccgtagagcccggcaagaaccctaagaatttccagacgatgccaggtatctttcagacaactaccggcgaaataggggcaatcgctcttgatttcaaacccggaacatcgggctcacctattatcaaccgagagggtaaggtcgtggggttatacggaaatggcgttgtgaccaaaaacggcgggtatgtctctggaattgcccaaactaatgctgagccggacggtccaacccccgaactggaggaagagatgtttaagaagcgcaacctcacaatcatggatttgcatcctggcagtgggaaaacgcggaagtacctgccagcaatagtgagagaagccattaaaaggcgtctccgcactctgatccttgcccccacccgggttgtggctgcggagatggaggaagcactgaagggattgcctatcagatatcagacaaccgccactaaatccgagcacacaggcagggaaattgtcgacctaatgtgccatgctaccttcacgatgcgactgctcagcccggtgcgggtacccaattacaacttaatcgtgatggatgaggcccactttactgacccagcatctatagccgctcgcggttatattagcacaagagttgggatgggagaagcggccgcaatcttcatgaccgctacccctcccggcactgccgatgcatttccacagtccaatgcccctattcaggacgaggagagggacatccccgaacggtcatggaacagtggcaatgagtggataacagatttcgctgggaagaccgtctggtttgtgccaagcattaaggccggaaacgacatcgcgaactgtctgagaaagaatggtaagaaagtgatccaactttctagaaagacattcgatactgaataccagaaaacgaagctgaacgactgggattttgtcgtaaccacagacatttccgagatgggcgcaaatttcaaggccgatcgcgtgatcgacccgaggcgttgcctcaaacctgttattttgactgatgggcccgagcgggtgatactggctggaccaatgcccgtcaccgtggcctcagctgcacagagaaggggccgcgttggtcgaaaccctcagaaggaaaatgaccaatacatcttcacagggcagccactcaacaatgatgaggaccatgcccactggaccgaagctaaaatgctgcttgacaacattaatactcccgagggcatcatccctgccctatttgaaccggagagagagaagagtgcagcgattgatggagaatatcggctgaaaggcgagagcaggaagacgttcgtggaattgatgcgccgtggggacttaccagtctggctggcccacaaagtggcttccgagggaataaagtacaccgatagaaagtggtgctttgacggtgaacggaacaatcagatcctcgaggagaacatggatgtagaaatttggacaaaagagggcgaaaagaaaaagctgaggccccgctggcttgacgcccgaacttattctgatcctctggcactcaaagagttcaaggactttgctgccgggagaaagtcgatcgcattggatctggtgaccgaaattggacgggttcccagccatctagcccacaggacacgcaatgctctggacaacctcgtcatgcttcatacctcagagcacggcggtagagcgtacaggcacgccgtggaggaactgccagagactatggaaacattattgctgctcgggctgatgatccttctgacgggcggagcaatgctattcttgatatccggcaaagggatcggaaagaccagtattggtctgatctgtgtggtcgcttctagcggcatgttatggatggccgatgttcctctacagtggattgcctccgcaatcgtgctggagtttttcatgatggtactccttatacccgagccagaaaaacaacggactcctcaggacaatcagctggcttatgtggtcattgggatcttgacactggccgcgattgtggctgccaacgagatgggactcctggaaaccaccaagcgtgatcttggcatgtcaaaagagccgggtgttgtgtctcccacaagctacctcgacgtcgacctgcatccagcaagtgcctggactttgtatgctgtagcaacgaccgtgatcacacctatgctgcgccacactatagaaaattccaccgccaacgttagcttagcggctatcgccaaccaagcagtggtcctaatggggctggataagggctggcccatttctaagatggacctcggagtgccacttctggccttgggctgctactcacaggtcaatcctctgacactcaccgctgccgtgctgcttttagttactcattacgcaatcattgggcccggactgcaggctaaagccacgcgagaggcgcagaagagaacagccgcaggcatcatgaaaaacccgaccgtggatggtataatgactattgacctcgatccagtaatctatgactccaagtttgagaaacaattgggacaggtgatgctgctagtcctgtgtgctgttcagctccttctgatgaggaccagttgggccttctgcgaagcattgacactggctactggacctatcaccacactctgggagggcagccccggtaagttttggaatacgaccattgccgtgtcgatggccaacatcttccggggctcttacctggcgggggctggattagcattttccataatgaaaagcgtcggcactgggaaacgcggaacaggctcacagggtgaaacccttggggagaagtggaaaaagaaactgaatcaactcagtagaaaggagttcgatctatataaaaagtctggaattactgaggtggacaggacagaggccaaggaaggcctgaaacggggtgagatcacccaccatgctgtatcccgaggcagcgccaagttgcagtggttcgtggaaagaaacatggttattccagaggggcgcgtgatcgatctgggatgtggcagaggcgggtggtcatactattgcgcagggctcaaaaaggtcacggaagtgcggggttacaccaaagggggacccggccacgaggagcctgtcccgatgagtacatatggctggaatatagtgaaacttatgagcgggaaggacgtattttacctgcccccagaaaaatgtgatactttgctgtgcgacatcggagagtcctctcctagccccaccgtagaagagtcccgtacaattagagtgctcaagatggtcgagccttggctaaagaacaatcagttctgtatcaaggtgctgaacccatacatgcccactgttattgaacaccttgagaggctgcagcgcaaacatggtggcatgctagtgcggaatcctctctcacgaaactctacccacgaaatgtattggatcagtaatgggacaggaaacattgtctcgagcgtgaatatggtatccagactgttgctgaacaggtttaccatgactcatcgccggccaacgatcgagaaggatgtggacctcggcgccggtacaagacacgttaacgctgaacccgagaccccgaatatggacgtcataggggagcgtattaggcggatcaaggaagaacactcttcaacttggcattacgatgacgaaaacccttataaaacctgggcgtaccacggaagctatgaggtgaaggccacaggctccgcaagttctatgatcaatggcgtggtcaaacttctgacgaagccatgggatgttgtgcccatggtaacccaaatggctatgactgacacaacccctttcgggcagcagcgcgtgtttaaagaaaaggtcgatactcgaacaccaagacccatgccgggaaccaggaaggtgatggagattacagccgagtggttatggcggactctgggtcgcaacaaaagacctaggttgtgcacccgagaagagttcataaagaaagttcggacgaatgcagccatgggcgctgtgtttaccgaagagaaccaatgggacagcgcccgtgcggcagtcgaagatgaggagttctggaagctcgtggacagagaacgcgagctgcataaactagggaagtgtggatcatgcgtatacaatatgatgggcaaaagggaaaagaaacttggtgagtttgggaaagccaagggatcccgggctatctggtatatgtggctgggcgccagatacctcgagttcgaagcactgggctttttgaacgaggatcactggttcagtcgcgaaaatagctactctggggttgagggagaaggtctgcataaactcggctatattcttagggacatctccaagattcccgggggagctatgtacgccgatgacacagctggctgggacactcgaatcaccgaggatgacctgcacaacgaggagaagataacacagcagatggatccagagcaccggcagttagccaatgcaatctttaagctgacttatcaaaacaaggtggtcaaagtgcagagacctacccccaagggtacggtgatggacattatctcaaggaaagatcagcgcgggagcggacaggtcggcacatacggcttgaataccttcactaacatggaagcgcaactcattcgtcagatggagggggaaggagttctgtcgaaggccgacctagagaatccatatcttctggagaaaaaggtgacacagtggctcgaaaccaagggtgtagagcggctgaaaagaatggctatctctggcgatgactgcgtggtcaagcccatagatgacaggttcgccaacgcattgttagctctgaacgatatggggaaagtgcgcaaggacattcctcagtggcaaccaagtaaaggatggcatgattggcagcaggttccgttttgttcccaccatttccacgaactcatcatgaaggacggccgaaaacttgtggtcccctgccggcctcaggacgagctgatcggtagagccaggattagccaaggggcaggatggtcactacgcgaaactgcctgtctgggcaaagcgtacgctcagatgtgggccctcatgtattttcacagacgggatttgaggctggcatccaatgccatatgctctgctgtgccagtacattgggttcccaccagccgtacaacgtggagtatccacgcccatcaccagtggatgaccactgaggacatgcttacagtgtggaaccgagtctggattgaggataatccttggatggaagacaagaccccagtgactacatgggaggatgttccctacctgggcaaacgcgaagaccaatggtgtgggtccctcatcggattaaccagcagagcaacgtgggctcagaacattctgacagccatccaacaggtgcggtctttgataggtaatgaggagttcctggattacatgccttcaatgaagaggtttcgcaaagaagaggaaagtgagggcgcgatctggtga

SEQ ID NO: 15680 - RNA, 9873 nt, synthetic construct
  misc_feature 1..9873: note = derived and/or modified CDS sequence (opt3) from DENV-3__AY744683__SS-prME
  source 1..9873: mol_type = other RNA
accagcctgtgcctcatgatgatgcttcccgccacactggctttccacttgacttcccgagacggagaacctaggatgatcgtggggaaaaacgaacggggaaaatctttactgtttaagacggcatcaggtattaatatgtgtaccttaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagggacttcgttgaaggattgtcaggtgctacgtgggtggatgtcgtgctggagcatggcgggtgcgtgactacaatggccaagaataaacccaccctggacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctcctgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccagccaatggagctgaagtatagttggaagacttggggaaaagcgaagattgtaacagccgaaacccaaaattccagctttatcattgatggccctaacacacccgagtgcccatctgcttcaagagcatggaacgtctgggaagtggaggactacggtttcggggtttttactaccaatatctggcttaaattgagggaaatgtatacgcagctctgtgaccaccggctgatgagtgccgctgtgaaggatgagcgcgccgtccacgcagacatgggatactggatagagagccagaaaaacggctcctggaagctagaaaaggcgtctctgatcgaggtgaaaacatgcacctggcccaagtcgcatactctctggagcaatggtgttctggaatccgatatgattatccctaaatcacttgccggcccaattagtcagcacaactacagaccggggtatcatacccaaacagctggaccctggcacttgggcaagctggagttagacttcaattactgcgaggggactaccgtggtaatcacagaaaactgtggaacgaggggcccttctctccgtaccactacagtcagcggtaaactgatacacgagtggtgctgtcggtcctgcacccttccacccctgcgatatatgggggaagatggatgttggtacggcatggagattagacctatcaatgaaaaggaggagaacatggtgaagtcattggtgagcgccggttctggcaaagcagacaattttactatgggggtcctctgcctggctatcctattcgaagaggttatgaggggaaagttcggcaaaaagcatatgattgccggggcactgtttacattcgtgctcctgctttccggacagatcacctggcgcgatatggcccacacgttgattatgataggcagtaacgctagcgaccggatgggtatgggggtaacttatctggcgttaatcgccacctttaaaattcagccattcctcgcactgggatttttccttagaaagctgacatctagggaaaatctactcctgggcgtgggcttggctatggccaccactctgcaattacccgaggatatcgaacagatggccaacgggattgctctcggactgatggcacttaagctgatcacacagtttgagacctaccagttgtggacagccctcgtctccctgatgtgttcaaatactatattcaccctaacggtggcgtggcgcacagctaccctgatccttgccgttattagtctcctgccggtgtgccaaagctcgtccatgcgaaaaactgactggttgcctatgaccgtcgcagccatgggtgtgccacccctgcctttatttatcttctctctcaaggatacactgaaacggcgtagctggccccttaacgagggcgttatggctgtggggctggtctcaattttggcaagttcctttctcagaaatgacgtaccaatggccggacctctggtggcgggcggtctactgatcgcttgttatgttataactgggacctctgccgatcttacggtggaaaaggcagccgacgtcacatgggaggaagaggctgaacagaccggagtgagccataacctcatgattactgtagacgatgacggcacaatgaggatcaaagatgacgagaccgagaacatcctgactgtgttgttaaagacagccctgctcattgtctccggcatattcccctactcaatcccagcaaccctgcttgtttggcacacgtggcagaaacagactcaacgcagcggggtgctgtgggatgtgccgagtcctcccgaaacccagaaggctgagttggaagagggagtctaccggattaagcagcagggtatctttggcaaaacacaagtgggggttggagtacagaaggagggcgtgttccataccatgtggcacgtcacaagaggtgccgtgctaactcacaatgggaaaaggctggaaccaaactgggcgaatgttaagaaagacctcatttcttatggaggcggctggaagctgtccgcccagtggcaaaagggggaggaagtgcaggtcatcgcagtggagcccggcaagaaccctaagaatttccagaccatgccaggtatatttcagacgacaactggcgaaatcggggctattgcccttgatttcaaacccggaaccagcggctcgcctatcattaaccgagagggtaaggtagtcgggttatacggaaatggcgtggttaccaagaacggcgggtatgtgtcaggaatcgctcaaaccaatgcagagccggacggtccaactcccgaactggaggaagagatgtttaagaagcgcaacctcaccataatggatttgcatcctggctctgggaaaacacggaagtacctgccagccattgtcagagaagccatcaaaaggcgtctccgcacgctgatccttgctcccactcgggtggttgcggcagagatggaggaagccctgaagggattgcctattagatatcagaccacagctaccaaaagtgagcacactggcagggaaatcgtggacctaatgtgccatgccacattcaccatgcgactgctctccccggtccgggtgcccaattacaacttaatagtaatggatgaggcacactttacggacccagccagcattgctgcgcgcggttatatctctactagagtggggatgggagaagccgcagctattttcatgacagccacccctcccggcaccgcagatgcctttccacagagcaatgctcctatccaggacgaggagagggacatacccgaacggtcctggaactcaggcaatgagtggattactgatttcgccgggaagacagtttggtttgtcccaagtatcaaggcgggaaacgacatcgcaaactgtctgagaaagaatggtaagaaagtgattcaacttagcagaaagaccttcgatacagaataccagaaaactaagctgaacgactgggattttgtggtcacgaccgacatctctgagatgggcgccaatttcaaggctgatcgcgtaattgacccgaggcgttgcctcaaacctgtgatattgacagatgggcccgagcgggttatcctggccggaccaatgcccgtgactgtcgcttccgcagcccagagaaggggccgcgtgggtcgaaaccctcagaaggaaaatgaccaatacattttcaccgggcagccactcaacaatgatgaggaccatgctcactggacagaagccaaaatgctgcttgacaacatcaatacccccgagggcatcattcctgcactatttgaaccggagagagagaagtcagcggccatagatggagaatatcggctgaaaggcgagagtaggaagactttcgttgaattgatgcgccgtggggacttaccagtgtggctggctcacaaagtcgccagcgagggaatcaagtacacggatagaaagtggtgctttgacggtgaacggaacaatcagattctcgaggagaacatggatgtggaaatctggaccaaagagggcgaaaagaaaaagctgaggccccgctggcttgacgcacgaacatattccgatcctctggctctcaaagagttcaaggactttgccgcagggagaaagtctattgccttggatctggtaactgaaatcggacgggtgccctcgcatctagctcacaggacccgcaatgcgctggacaacctcgttatgcttcatacaagcgagcacggcggtagagcctacaggcacgcagtcgaggaactgccagagaccatggaaactttattgctgctcgggctgatgatacttctgacaggcggagctatgctattcttgatctcaggcaaagggattggaaagacgtccatcggtctgatttgtgtggtggccagttctggcatgttatggatggccgatgtccctctacagtggatcgcaagcgctatagttctggagtttttcatgatggtgctccttattcccgagccagaaaaacaacggacccctcaggacaatcagctggcctatgtagtgatcgggattttgactctggcggctatcgtcgccgcaaacgagatgggactcctggaaacaaccaagcgtgatcttggcatgtccaaagagccgggtgtggtttcacccacctcttacctcgacgtggacctgcatccagccagcgcttggacattgtatgcagtcgccactacggtaataacccctatgctgcgccacacaatcgaaaatagtactgcgaacgtgtccttagctgccattgcaaaccaagccgttgtgctaatggggctggataagggctggcccatcagcaagatggacctcggagtcccacttctggctttgggctgctactctcaggtgaatcctctgaccctcacagccgcagtcctgcttttagtgacccattacgctattatcgggcccggactgcaggccaaagcgactcgagaggcccagaagagaacggcagctggcataatgaaaaacccgacagttgatggtattatgaccatcgacctcgatccagtgatctatgactcaaagtttgagaaacaattggggcaggtaatgctgctagtgctgtgtgccgtccagctccttctgatgaggacttcctgggcattctgcgaagctctaaccctggccacaggacctattactaccctctgggagggcagtcccggtaagttttggaatacaacgatcgccgttagcatggcgaacatattccggggctcgtacctggctggggcaggattagccttttctattatgaagtccgtgggcaccgggaaacgcggaactggcagccagggtgaaacacttggggagaagtggaaaaagaaactgaatcaactctcaagaaaggagttcgatctatataaaaagagtggaatcaccgaggtcgacaggactgaggctaaggaaggcctgaaacggggtgagattacacaccatgccgtgtctcgaggctccgcaaagttgcagtggttcgtagaaagaaacatggtgatcccagaggggcgcgttatagatctgggatgtggcagagggggatggagctactattgcgccggcctcaaaaaggtgaccgaagtccggggttacacgaaagggggacccggccacgaggagcctgtgccgatgtcaacctatggctggaatatcgtcaaacttatgagtgggaaggacgtgttttacctgcccccagaaaaatgtgatacattgctgtgcgacattggagagagctccccttctcccactgttgaagagagccgtaccatcagagtactcaagatggtggagccttggttgaaaaacaatcagttctgtattaaggtcctgaacccatacatgcccacagtgatcgaacaccttgagaggctgcagcgcaaacatggtggcatgctagttcggaatcctctctcccgaaactcaactcacgaaatgtattggatttctaatgggaccggaaacatcgtgagttcggtcaatatggtgagcagactgttgctgaacaggtttacaatgacccatcgccggccaactatagagaaggatgtagacctcggcgctggtacgagacacgtgaacgcggaacccgagacaccgaatatggacgttattggggagcgtatcaggcggatcaaggaagaacactcctctacctggcattacgatgacgaaaacccttataaaacttgggcctaccacggatcatatgaggtcaaggcaaccggcagcgcttccagtatgattaatggcgtggtgaaacttctgacaaagccatgggatgtcgttcccatggtgacgcaaatggccatgaccgacactacacctttcgggcagcagcgcgtatttaaagaaaaggtggatacccgaactccaagacccatgccgggaacaaggaaggtcatggagataaccgcagagtggttatggcggacactgggtcgcaacaaaagacctaggttgtgcactcgagaagagttcatcaagaaagtgcggaccaatgccgctatgggcgccgtttttacggaagagaaccaatgggactctgcgcgtgcagccgtggaagatgaggagttctggaagctcgtcgacagagaacgcgagctgcataaactagggaagtgtggaagctgcgtgtacaatatgatgggcaaaagggaaaagaaacttggtgagtttgggaaagctaagggatcacgggccatttggtatatgtggctgggcgcaagattcctcgagtttgaagctctgggcttcttgaacgaggatcactggttttcccgcgaaaatagttacagcggggtagagggagaaggtctgcataaactcggctacatccttagggacatttctaagatccccgggggagccatgtatgctgatgacaccgccggctgggacacacgaataactgaggatgacctgcacaacgaggagaaaatcacccagcagatggatccagagcaccggcagttagcaaatgcgattttcaagctgacataccaaaacaaggttgtgaaagtccagagacctactcccaagggtaccgtgatggacatcatttccaggaaagatcagcgcgggtcaggacaggtgggcacgtatggcttgaatacattcaccaacatggaagcccaactcatccgtcagatggagggggaaggagtcctgagcaaggctgacctagagaatccacatcttctggagaaaaaggttactcagtggctcgaaacaaagggtgtggagcggctgaaaagaatggccatatcgggcgatgactgcgtagtgaagcccattgatgacaggtttgcaaacgctttgttagccctgaacgatatggggaaagtccgcaaggacatccctcagtggcaaccatctaaaggatggcacgattggcaacaggtgccgttctgtagtcatcactttcacgaactcatcatgaaggacggccgaaaacttgttgtgccctgccggcctcaggacgagctgattggtagagcaaggatatcccaaggggccggatggagcctacgcgaaaccgcgtgtctgggcaaggcttacgcccagatgtgggcactcatgtatttccatagacgggatttgaggctggcctcaaatgctatctgctccgccgtcccagtgcactgggtacccacttctcgtaccacatggagcattcatgcacaccatcagtggatgacgaccgaggacatgcttactgtttggaaccgagtgtggatcgaggataatccttggatggaagacaagacaccagtcaccacttgggaggatgtgccctacctgggcaaacgcgaagaccaatggtgtgggagtctcattggattaacatccagagctacctgggcccagaacatcctgacggcgatacagcaggttcggagcttgatcggtaatgaggagtttctggattatatgccttctatgaagaggttccgcaaagaagaggaatcagagggcgctatttggtga

SEQ ID NO: 15681 - RNA, 9873 nt, synthetic construct
  misc_feature 1..9873: note = derived and/or modified CDS sequence (opt3) from DENV-3__AY744684__SS-prME
  source 1..9873: mol_type = other RNA
accagcctgtgcctcatgatgatgcttcccgccacactggctttccacttgacttcccgagacggagagcctaggatgatcgtggggaagaacgaacggggaaaatctttactgtttaagacggcatcaggtattaatatgtgtaccttaatagccatggatctcggcgagatgtgcgacgatacagtcacttacaaatgtccactgatcaccgaagttgagccggaagacattgattgctggtgtaaccttacaagtacctgggtgacttatgggacatgcaatcaggcgggagagcatcgccgagacaagcgtagcgtagctctggcaccccacgtgggcatgggtttggataccagaacgcagacttggatgtccgcagagggggcctggaggcaggtcgaaaaagtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagggacttcgttgaaggattgtcaggtgctacgtgggtggatgtcgtgctggagcatggcgggtgcgtgactacaatggccaagaataaacccaccctggacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagacccaaggggtgactgcagaaatcacgccccaggcttctacagtcgaggccattctccctgaatacggaacccttggcctggagtgcagcccacgaactggtttggactttaatgagatgatcctactgaccatgaaaaacaaggcgtggatggtgcatagacagtggttctttgatctcccgctgccctggacatccggggccaccactgaaacacctacgtggaataaaaaggagcttctggtaaccttcaaaaacgcacacgctaagaagcaagaagttgtggtcttgggctcacaggagggagccatgcacactgctctcacaggcgccaccgaaatccagacaagtgggggaactagcatttttgcaggtcatctgaaatgtaggttaaagatggacaaactggagctaaagggcatgtcttatgccatgtgcctcaatgctttcgtgctgaaaaaggaggtctccgaaacccagcacgggacgatacttatcaaggtggagtacaaaggagaagatgcgccatgtaagattcccttctcaaccgaggacggccaaggtaaagcacataacgggcggttgatcacagccaaccctatagttactaagaaagaggaaccagtgaatattgaggctgaacccccgtttggcgagagcaacatcgtaatcggaattggcgataaggccctgaagatcaattggtacaaaaaggggagttctattggaaaaatgttcgaagcaaccgcccgtggtgctcgcagaatggccatactcggcgacacagcatgggattttgggtccgtcggaggcgtgctgaacagccttggtaagatggttcaccagatcttcgggtcggcgtatactgctctgttttctggcgtgtcctggattatgaaaatcggaatcggcgtcttgctcacctggattgggctaaattcaaagaacacgagtatgagcttctcctgcatagtgatcggaattatcacattatacctgggcgccgtagtgcaggcagacatgggttgtgttattaattggaaggggaaagagctaaagtgcggatctggcatctttgtcaccaacgaggtgcatacttggacagaacagtataaattccaagccgatagccctaagaggctcgctaccgccatagccggtgcttgggagaatggcgtgtgtgggatccggtcaactacccgaatggaaaacctgctttggaaacagattgccaatgagttgaactacatcctgtgggaaaataacattaagctcacaatcgtcgttggagacgtgataggcgtgctggagcaggggaaacgcacgttaacaccccagccaatggagctgaagtatagttggaagacttggggaaaagcgaagattgtaacagccgaaacccaaaattccagctttatcattgatggccctaacacacccgagtgcccatctgcttcaagagcatggaacgtctgggaagtggaggactacggtttcggggtttttactaccaatatctggcttaaattgagggaaatgtatacgcagctctgtgaccaccggctgatgagtgccgctgtgaaggatgagcgcgccgtccacgcagacatgggatactggatagagagccagaaaaacggctcctggaagctagaaaaggcgtctctgatcgaggtgaaaacatgcacctggcccaagtcgcatactctctggagcaatggtgttctggaatccgatatgattatccctaaatcacttgccggcccaattagtcagcacaactacagaccggggtatcatacccaaacagctggaccctggcacttgggcaagctggagttagacttcaattactgcgaggggactaccgtggtaatcacagaaaactgtggaacgaggggcccttctctccgtaccactacagtcagcggtaaactgatacacgagtggtgctgtcggtcctgcacccttccacccctgcgatatatgggggaagatggatgttggtacggcatggagattagacctatcaatgaaaaggaggagaacatggtgaagtcattggtgagcgccggttctggcaaagcagacaattttactatgggggtcctctgcctggctatcctattcgaagaggttatgaggggaaagttcggcaaaaagcatatgattgccggggcactgtttacattcgtgctcctgctttccggacagatcacctggcgcgatatggcccacacgttgattatgataggcagtaacgctagcgaccggatgggtatgggggtaacttatctggcgttaatcgccacctttaaaattcagccattcctcgcactgggatttttccttagaaagctgacatctagggaaaatctactcctgggcgtgggcttggctatggccaccactctgcaattacccgaggatatcgaacagatggccaacgggattgctctcggactgatggcacttaagctgatcacacagtttgagacctaccagttgtggacagccctcgtctccctgatgtgttcaaatactataagtaccctaacggtggcgtggcgcacagctaccctgatccttgccgttattagcctcctgccggtgtgccaatcgtcctctatgcgaaaaactgactggttgcctatgaccgtcgcagccatgggtgtgccacccctgcctttattcatctttagcctcaaggatacactgaaacggcgttcatggccccttaacgagggcgttatggctgtggggctggtcagtattttggcatcctctttcctcagaaatgacgtaccaatggccggacctctggtggcgggcggtctactgatcgcttgttatgttataactgggaccagcgccgatcttacggtggaaaaggcagccgacgtcacatgggaggaagaggctgaacagaccggagtgtcccataacctcatgattactgtagacgatgacggcacaatgaggatcaaagatgacgagaccgagaacatcctgactgtgttgttaaagacagccctgctcattgtctcaggcatatttccctacagcatcccagcaaccctgcttgtttggcacacgtggcagaaacagactcaacgcagtggggtgctgtgggatgtgccgtctcctcccgaaacccagaaggctgagttggaagagggagtctaccggattaagcagcagggtatcttcggcaaaacacaagtgggggttggagtacagaaggagggcgtgtttcataccatgtggcacgtcacaagaggtgccgtgctaactcacaatgggaaaaggctggaaccaaactgggcgaatgttaagaaagacctcatttcctatggaggcggctggaagctgagcgcccagtggcaaaagggggaggaagtgcaggtcatcgcagtggagcccggcaagaaccctaagaatttccagaccatgccaggtatattccagacgacaactggcgaaatcggggctattgcccttgattttaaacccggaacctcgggctcacctatcattaaccgagagggtaaggtagtcgggttatacggaaatggcgtggttaccaagaacggcgggtatgtgtctggaatcgctcaaaccaatgcagagccggacggtccaactcccgaactggaggaagagatgttcaagaagcgcaacctcaccataatggatttgcatcctggcagtgggaaaacacggaagtacctgccagccattgtcagagaagccatcaaaaggcgtctccgcacgctgatccttgctcccactcgggtggttgcggcagagatggaggaagccctgaagggattgcctattagatatcagaccacagctaccaaatccgagcacactggcagggaaatcgtggacctaatgtgccatgccacatttaccatgcgactgctcagcccggtccgggtgcccaattacaacttaatagtaatggatgaggcacacttcacggacccagcctctattgctgcgcgcggttatatcagcactagagtggggatgggagaagccgcagctatttttatgacagccacccctcccggcaccgcagatgccttcccacagtccaatgctcctatccaggacgaggagagggacatacccgaacggtcatggaacagtggcaatgagtggattactgattttgccgggaagacagtttggttcgtcccaagcatcaaggcgggaaacgacatcgcaaactgtctgagaaagaatggtaagaaagtgattcaactttctagaaagacctttgatacagaataccagaaaactaagctgaacgactgggatttcgtggtcacgaccgacatctccgagatgggcgccaattttaaggctgatcgcgtaattgacccgaggcgttgcctcaaacctgtgatattgacagatgggcccgagcgggttatcctggccggaccaatgcccgtgactgtcgcttcagcagcccagagaaggggccgcgtgggtcgaaaccctcagaaggaaaatgaccaatacattttcaccgggcagccactcaacaatgatgaggaccatgctcactggacagaagccaaaatgctgcttgacaacatcaatacccccgagggcatcattcctgcactattcgaaccggagagagagaagagtgcggccatagatggagaatatcggctgaaaggcgagagcaggaagacttttgttgaattgatgcgccgtggggacttaccagtgtggctggctcacaaagtcgcctccgagggaatcaagtacacggatagaaagtggtgcttcgacggtgaacggaacaatcagattctcgaggagaacatggatgtggaaatctggaccaaagagggcgaaaagaaaaagctgaggccccgctggcttgacgcacgaacatattctgatcctctggctctcaaagagtttaaggacttcgccgcagggagaaagtcgattgccttggatctggtaactgaaatcggacgggtgcccagccatctagctcacaggacccgcaatgcgctggacaacctcgttatgcttcatacatcagagcacggcggtagagcctacaggcacgcagtcgaggaactgccagagaccatggaaactttattgctgctcgggctgatgatacttctgacaggcggagctatgctctttttgatctccggcaaagggattggaaagacgagtatcggtctgatttgtgtggtggcctctagcggcatgttatggatggccgatgtccctctacagtggatcgcatccgctatagttctggagttctttatgatggtgctccttattcccgagccagaaaaacaacggacccctcaggacaatcagctggcctatgtagtgatcgggattttgactctggcggctatcgtcgccgcaaacgagatgggactcctggaaacaaccaagcgtgatcttggcatgtcaaaagagccgggtgtggtttctcccaccagctacctcgacgtggacctgcatccagccagtgcttggacattgtatgcagtcgccactacggtaataacccctatgctgcgccacacaatcgaaaattccactgcgaacgtgagcttagctgccattgcaaaccaagccgttgtgctaatggggctggataagggctggcccatctctaagatggacctcggagtcccacttctggctttgggctgctactcacaggtgaatcctctgaccctcacagccgcagtcctgcttttagtgacccattacgctattatcgggcccggactgcaggccaaagcgactcgagaggcccagaagagaacggcagctggcataatgaaaaacccgacagttgatggtattatgaccatcgacctcgatccagtgatctatgactccaagttcgagaaacaattggggcaggtaatgctgctagtgctgtgtgccgtccagctccttctgatgaggaccagttgggcattttgcgaagctctaactctggccacaggacctattactaccctctgggagggcagccccggtaagttctggaatacaacgatcgccgtttcgatggcgaacatatttcggggctcttacctggctggggcaggattagccttctccattatgaaaagcgtgggcaccgggaaacgcggaactggctcacagggtgaaacacttggggagaagtggaaaaagaaactgaatcaactcagtagaaaggaatttgatctatataaaaagtctggaatcaccgaggtcgacaggactgaggctaaggaaggcctgaaacggggtgagattacacaccatgccgtgtcccgaggcagcgcaaagttgcagtggttcgtagaaagaaacatggtgatcccagaggggcgcgttatagatctgggatgtggcagagggggatggtcatactattgcgccggcctcaaaaaggtgaccgaagtccggggttacacgaaagggggacccggccacgaggagcctgtgccgatgagtacctatggctggaatatcgtcaaacttatgagcgggaaggacgtgttctacctgcccccagaaaaatgtgatacattgctgtgcgacattggagagtcctctcctagccccactgttgaagagtcccgtaccatcagagtactcaagatggtggagccttggttgaaaaacaatcagttttgtattaaggtcctgaacccatacatgcccacagtgatcgaacaccttgagaggctgcagcgcaaacatggtggcatgctagttcggaatcctctctcacgaaactctactcacgaaatgtattggattagtaatgggaccggaaacatcgtgtcgagcgtcaatatggtgtccagactgttgctgaacaggttcacaatgacccatcgccggccaactatagagaaggatgtagacctcggcgctggtacgagacacgtgaacgcggaacccgagacaccgaatatggacgttattggggagcgtatcaggcggatcaaggaagaacactcttcaacctggcattacgatgacgaaaacccttataaaacttgggcctaccacggaagctatgaggtcaaggcaaccggctccgctagttctatgattaatggcgtggtgaaacttctgacaaagccatgggatgtcgttcccatggtgacgcaaatggccatgaccgacactacaccttttgggcagcagcgcgtattcaaagaaaaggtggatacccgaactccaagacccatgccgggaacaaggaaggtcatggagataaccgcagagtggttatggcggacactgggtcgcaacaaaagacctaggttgtgcactcgagaagagtttatcaagaaagtgcggaccaatgccgctatgggcgccgttttcacggaagagaaccaatgggacagcgcgcgtgcagccgtggaagatgaggagttttggaagctcgtcgacagagaacgcgagctgcataaactagggaagtgtggatcatgcgtgtacaatatgatgggcaaaagggaaaagaaacttggtgagttcgggaaagctaagggatcccgggccatttggtatatgtggctgggcgcaagatacctcgagtttgaagctctgggcttcttgaacgaggatcactggtttagtcgcgaaaatagctactctggggtagagggagaaggtctgcataaactcggctatatccttagggacatttccaagatccccgggggagccatgtacgctgatgacaccgccggctgggacacacgaataactgaggatgacctgcacaacgaggagaaaatcacccagcagatggatccagagcaccggcagttagcaaatgcgattttcaagctgacatatcaaaacaaggttgtgaaagtccagagacctactcccaagggtaccgtgatggacatcatttcaaggaaagatcagcgcgggagcggacaggtgggcacgtacggcttgaatacatttaccaacatggaagcccaactcatccgtcagatggagggggaaggagtcctgtcgaaggctgacctagagaatccacatcttctggagaaaaaggttactcagtggctcgaaacaaagggtgtggagcggctgaaaagaatggccatatctggcgatgactgcgtagtgaagcccattgatgacaggttcgcaaacgctttgttagccctgaacgatatggggaaagtccgcaaggacatccctcagtggcaaccaagtaaaggatggcacgattggcaacaggtgccgttctgttcccatcactttcacgaactcatcatgaaggacggccgaaaacttgttgtgccctgccggcctcaggacgagctgattggtagagcaaggataagccaaggggccggatggtcactacgcgaaaccgcgtgtctgggcaaggcttatgcccagatgtgggcactcatgtacttccatagacgggatttgaggctggcctccaatgctatctgctctgccgtcccagtgcactgggtacccactagccgtaccacatggagtattcatgcacaccatcagtggatgacgaccgaggacatgcttactgtttggaaccgagtgtggatcgaggataatccttggatggaagacaagacaccagtcaccacttgggaggatgtgccctatctgggcaaacgcgaagaccaatggtgtgggtccctcattggattaacaagcagagctacctgggcccagaacatcctgacggcgatacagcaggttcggtctttgatcggtaatgaggagtttctggattacatgccttcaatgaagaggttccgcaaagaagaggaaagtgagggcgctatttggtga

SEQ ID NO: 15682 - RNA, 9873 nt, synthetic construct
  misc_feature 1..9873: note = derived and/or modified CDS sequence (opt3) from DENV-3__AY744685__SS-prME
  source 1..9873: mol_type = other RNA
accagcctgtgcctcatgatgatgcttcccgccacactggctttccacttgacttccagagacggcgaacctaggatgatcgtggggaagaacgaacggggaaagtctttactgtttaagacggcctcaggtattaatatgtgtaccctgatagccatggatctcggcgaaatgtgcgacgatacagtcacttacaagtgtccactgatcaccgaagttgagccggaagacattgattgctggtgtaaccttacaagtacctgggtgacttatgggacatgcaatcaggcgggagagcaccgccgagacaagcgtagcgtagctctggcaccccacgtgggcatgggtttggataccaggacgcagacttggatgtccgcagagggggcctggaggcaggtcgaaaaggtggagacctgggctttccggcatcctggatttacaatcctcgcactgttcctggcccactacattggcacttctctcacccagaaggttgtgatctttatattactgatgcttgtcacaccatcgatgaccatgcgctgtgtgggcgtagggaacagagacttcgttgaaggattgtcaggtgctacgtgggtggatgtcgtgctggagcatggcgggtgcgtgactacaatggccaagaataagcccaccctagacatcgagctccagaagactgaagcgacacaactggcaacccttaggaaactgtgtattgagggaaagatcacgaacgtcaccacagatagccggtgccctactcagggcgaagccattttgccagaggaacaggaccagaattatgtttgtaaacacacctacgtggatcgcggttgggggaacggatgcggcctctttggcaaggggagtctggtaacatgcgctaagttccaatgtttagagtccatcgagggaaaagccgtgcagcacgaaaatctgaagtatactgtcataattaccgtgcatacaggtgaccagcaccaggttggcaacgagatgcaaggggtgaccgcagaaatcactccccaggcttctacggtcgaggccattctccctgaatacggaacacttggcctggagtgcagcccacgaaccggtttggactttaatgagatgatcctactgactatgaaaaacaaggcgtggatggtgcatagacagtggttctttgatctcccgctgccctggacctccggggccacaaccgaaactcctacatggaataaaaaggagcttctggtaacgttcaaaaacgcacacgctaagaagcaagaagttgtggtcttgggctcacaggagggagccatgcacaccgctctcactggcgccacagaaatccagaccagtgggggaacaagcatttttgcaggtcatctgaaatgtaggttaaagatggacaaactggagctaaagggcatgtcttatgccatgtgcctcaatgctttcgtgctgaaaaaggaggtctccgaaactcagcacgggaccatacttatcaaggtggagtacaaaggagaagatgcgccatgtaagattcccttctcaacggaggacggccaaggtaaagcacataacgggcggttgatcaccgccaaccctatagttacaaagaaagaggaaccagtgaatattgaggctgaacccccgtttggcgagagcaacatcgtaatcggaattggcgataaggccctgaagatcaattggtacaaaaaggggagttctattggaaaaatgttcgaagcaactgcccgtggtgctcgcagaatggccatactcggcgacaccgcatgggattttgggtccgtcggaggcgtgctgaacagccttggtaagatggttcaccagatcttcgggtcggcgtatacagctctgttttctggcgtgtcctggattatgaaaatcggaatcggcgtcttgctcacttggattgggctaaattcaaagaacgccagtatgagcttctcctgcatagtgatcggaattatcaccttatacctgggcgcagtagtgcaggccgacatgggttgtgttattaattggaaggggaaagagctaaagtgcggatctggcatctttgtcacgaacgaggtgcatacatggaccgaacagtataaattccaagctgatagccctaagaggctcgccactgcaatagctggtgcctgggagaatggcgtgtgtgggatccggtcaacaacccgaatggaaaacctgctttggaaacagattgcgaatgagttgaactacatcctgtgggaaaataacattaagctcactatcgtcgttggagacgtgataggcgtgctggagcaggggaaacgcaccttaacaccccagccaatggagctgaagtatagttggaagacgtggggaaaagccaagattgtaaccgctgaaactcaaaattccagctttatcattgatggccctaacacacccgagtgcccatctgcacttagagcctggaacgtctgggaagtggaggactacggtttcggggtttttaccacaaatatctggttgaaactcagggaaaagtatactcagctgtgtgaccaccggctaatgtcagctgccgtgaaagatgagcgcgcagtccacgcggacatgggatactggatagagagtcagaagaacggcagctggaagctggaaaaagcctccctcatcgaggtgaagacctgcacgtggcccaaatctcatacactgtggtcgaatggtgttcttgaaagcgatatgattatccctaagtccttggctggcccaatttcacagcacaactacagaccggggtatcatacccaaactgccggaccctggcacctgggcaaattagagctcgacttcaattactgcgaggggaccacagtggtaatcactgaaaactgtggaataaggggccctagtctgcgtaccacaacggtctctggtaaacttattcacgagtggtgctgtcggagctgcaccctgccacccttgcgatatatgggggaagatggatgttggtacggcatggagatcagacctatcaatgaaaaggaggagaacatggtgaaatccctcgtgtcagcaggtagcggcaagactgacaattttacaatgggggtcctgtgcctagctattctgttcgaagaggttatgaggggaaaattcggcaagaaacatatgatcgccggggcactctttaccttcgtgctgcttttgtctggacagattacttggcgcgatatggcccacacactgataatgatcggctccaacgctagtgaccggatgggtatgggggtaacctatttagcgctcattgccacgtttaagatccagccattcctggcacttggatttttcctgagaaagctaactagcagggaaaatctcctgttgggcgtgggcctggctatggccaccacattacaactccccgaggatattgaacagatggccaacgggatcgctctgggacttatggcactgaaattgataacccagtttgagacttaccagctctggacagccctgatctctctaatgtgttccaataccattttcacactgactgtcgcgtggcgcaccgctacgcttatcctcgccgtgatttcactgttgccggtttgccaaagtagctcgatgcgaaagacagactggctgcctatgaccgtggcagccatgggtgtcccacccttacctctctttatcttctccctgaaagatactcttaagcggcgttcttggcccctgaacgagggcgtgatggctgttgggttggtgagcatactcgcatcaagttttctgagaaatgacgtcccaatggccggacctctagtagcgggcggtctgcttattgcttgttatgtgatcaccgggacatccgccgatctcactgttgaaaaagcagccgacgtgacctgggaggaagaggctgaacagacgggagtctctcataacctgatgatcacagtggacgatgacggcaccatgaggattaaggatgacgagactgagaacatattgacagtattactgaaaaccgccctcctgatcgtgagcggcattttcccctactccatcccagcaactcttctggtctggcacacatggcagaagcagacccaacgctcaggggttttgtgggatgtgccgagccctcccgaaacgcagaaggctgagctagaagagggagtgtaccggattaaacagcagggtatctttggcaagactcaagtcggggtgggagttcagaaagagggcgtattccataccatgtggcacgtgacaagaggtgccgtcctgacccacaatgggaagaggctcgaaccaaactgggcgaatgtgaaaaaggacctgataagttatggaggcggctggaaactttctgcccagtggcaaaaaggggaggaagttcaggtgatcgcagtcgagcccggaaagaaccctaaaaatttccagacaatgccaggtatttttcagactaccacgggcgaaatcggggctattgccttagatttcaagcccggaacatccggcagccctatcataaaccgagagggtaaagtggtagggctgtacggaaatggcgtcgtgactaagaacggcgggtatgtttcgggaattgctcaaaccaatgcagagccggacggtccaacacccgaactcgaggaagagatgtttaagaaacgcaacttgaccatcatggatctgcatcctggctcagggaagactcggaaatacctcccagccatcgtgagagaagccattaagaggcgtctgcgcacccttatcctggctcccacacgggtcgtggcggcagagatggaggaagccttgaaaggactacctataagatatcagacgactgctaccaagtctgagcacacaggcagggaaattgttgacctgatgtgccatgccaccttcactatgcgactcttaagtccggtgcgggtccccaattacaacctgatcgtgatggatgaggcacactttacagacccagcctccattgctgcgcgcggttatatcagcaccagagtagggatgggagaagccgcagctatattcatgacggccactcctcccggcacagcagatgcctttccacagtctaatgctcctattcaggacgaggagagggacatccccgaacggagctggaactccggcaatgagtggatcaccgatttcgccgggaagaccgtgtggtttgttccatcaattaaagcgggaaacgacatcgcaaactgtcttcgaaagaatggtaaaaaggtcattcaactgagtagaaaaactttcgatacagaataccagaagaccaagctcaacgactgggattttgtggtgacaactgacataagcgagatgggcgccaatttcaaagctgatcgcgtcatcgacccgaggcgttgcttgaagcctgtaattctgacggatgggcccgagcgggtgatcctcgccggaccaatgcccgttaccgtggcttctgcagcccagagaaggggccgcgtcggtcgaaactcccagaaagaaaatgaccaatacatcttcacagggcagcctctgaacaatgatgaggaccatgctcactggactgaagccaagatgcttctagacaacattaataccccagagggcataatccccgcactgtttgaacctgagagagagaaatcagcggccattgatggagaatatcggttgaagggcgagagtaggaaaacattcgtggaattaatgcgccgtggggacctgccggtttggctcgctcacaaggtggccagcgagggaatcaagtacaccgatagaaaatggtgctttgacggtgaacggaacaatcagattctggaggagaacatggatgtcgaaatctggactaaggagggcgagaagaagaaacttaggccacgctggctggacgcacgaacgtattccgatcccctcgctttgaaggagttcaaggactttgccgcagggagaaaatctatagccctggatctagtgaccgaaatcggacgggtaccttcgcatctggctcacaggacacgcaatgcgctcgacaaccttgtgatgctgcatactagcgagcacggcggtagagcctacaggcacgcagttgaggaattacccgagaccatggaaacattgctgctcctggggcttatgattctgctcaccggcggagctatgttgttcctgatctcaggcaaggggattggaaaaacttccatcggtttaatatgtgtcgtggccagttctggcatgctatggatggccgatgtgccactgcagtggattgcaagcgctatcgtcctcgagtttttcatgatggttcttctgattcctgagcccgaaaagcaacggacaccacaggacaatcagttggcctatgtggtaatcgggatactgacgctcgcggctatcgtggccgcaaacgagatgggactgcttgaaaccactaaacgtgatctcggcatgtccaaggagcctggtgtcgtgtcaccgacatcttacctggacgttgacttgcatcccgccagcgcttggaccctgtatgcagtggccaccacagtcattactccaatgttacgccacacgatcgaaaatagtaccgcgaacgtatccctagctgccattgcaaaccaagccgtggttctgatggggctcgataagggctggcctatcagcaaaatggaccttggagtgcccctgttggctctgggctgctactctcaggtcaatccactcacactgactgccgcagtgcttttactggtcacccattacgctataattgggcctggactccaggccaaggcgacacgagaggcccagaaaagaaccgcagctggcatcatgaagaaccccactgtggatggtatcatgacgattgacttggatccggttatctatgactcaaaatttgagaagcaactgggacaggtgatgctactggtactctgtgccgtgcagcttctgttgatgaggacatcctgggcattctgcgaagctctgaccctcgccactggaccaataaccacactgtgggagggcagtcctggtaagttttggaatactaccattgccgtcagcatggcgaacatcttccggggctcgtacttagctggggcaggacttgccttttctattatgaaatccgttggcacagggaagcgcggaacgggcagccagggtgaaaccctgggggagaaatggaagaaaaagctcaatcaactatcaagaaaagagttcgatctgtataagaagagtggaatcactgaggtggacaggacagaggctaaagaaggcttgaagcggggtgagataacccaccatgccgtctctcgaggctccgcaaaactgcagtggttcgtggaaagaaacatggtaatccccgaggggcgcgtgattgatctcggatgtggcagaggcgggtggagctactattgcgccgggcttaagaaagttactgaagtgcggggttacacaaaagggggaccaggccacgaggagcccgtccctatgtcaacctatggctggaatatcgtgaagctgatgagtgggaaagacgtcttttacttgccgcccgaaaagtgtgatacgctgctctgcgacattggagagagctccccatctcctaccgtggaagagagccgtacaatcagagttttaaaaatggtagagccctggctgaagaacaatcagttctgtattaaagtgcttaacccttacatgccaactgtcatcgaacacctggagaggctacagcgcaagcatggtggcatgctcgtgcggaatcccctgtcccgaaactcaacccacgaaatgtattggatatctaatgggacaggaaacattgttagttcggtgaatatggtcagcagattgctgctcaacaggtttactatgacccatcgccggcctacaatcgagaaggatgtggaccttggcgctggtaccagacacgtaaacgcggaaccagagactcccaatatggacgtgatcggggagcgtattaggcggataaaagaagaacactcctctacgtggcattacgatgacgaaaacccgtataagacatgggcctaccacggatcatatgaggttaaagcaaccggcagcgcttccagtatgatcaatggcgtcgtgaagctgttaactaaaccttgggatgtggtcccaatggttacccaaatggccatgacagacacgacccccttcgggcagcagcgcgtgtttaaggaaaaggtagatactcgaacacctagaccaatgcccggaaccaggaaagtgatggagattactgcagagtggctgtggcggacattgggtcgcaacaagagaccgaggctctgcacccgagaagagttcatcaaaaaggtccggacaaatgccgctatgggcgccgtgtttactgaagagaaccaatgggactctgcgcgtgcagccgttgaagatgaggagttctggaaactggtggacagagaacgcgagctacataaacttgggaaatgtggaagctgcgtctacaatatgatgggcaagagggaaaagaaactgggtgagtttgggaaggctaaaggatcacgggccatttggtatatgtggctcggcgcaagatacctggagttcgaggctttgggctttctgaacgaggatcactggttctcccgcgaaaatagtcatagcggggtggagggagaaggtctccacaaacttggctacatcctgagggacatatctaaaatccctgggggagccatgtatgctgatgacaccgccggctgggacacgcgaattaccgaggatgacttacacaacgaggaaaagatcacacagcagatggatcccgagcatcggcagctggcaaatgcgatttttaagttgacttaccaaaacaaagtagttaaggtgcagagaccaacccctaaaggtacagtcatggacatcatatccaggaaggatcagcgcgggtcaggacaggtgggcacttatggcctcaataccttcacgaacatggaagcccaactgattcgtcagatggagggggaaggagtgctaagcaaagctgaccttgagaatccccatctgctcgagaagaaggtcacacagtggctggaaaccaaaggtgttgagcggttgaagagaatggccatctcgggcgatgactgcgtggtaaaaccaatcgatgacaggttcgcaaacgctttactggccctcaacgatatggggaaggtgcgcaaagacattccccagtggcaaccttctaagggatggcatgattggcagcaggtcccattttgtagtcaccacttccatgaacttataatgaaggacggccgaaaactggtggttccgtgccggccccaggacgagctaatcggtagagcaaggatttcccaaggggccggatggagcctgcgcgaaactgcgtgtctcggcaaggcttacgcccagatgtgggcattgatgtattttcacagacgggatctgaggcttgcctcaaatgctatctgctccgccgtgcctgtccattgggtgccaacatctcgtaccacttggagcattcacgcacatcaccagtggatgaccacagaggacatgctgacggtatggaaccgagtttggatcgaggataatccctggatggaagacaaaacccctgtgactacatgggaggatgtcccatacctcggcaagcgcgaagaccaatggtgtgggagtttaataggactgacctccagagctacttgggcccagaacatcttgacagcgattcaacaggtgcggagcctgatcggtaatgaggagttcctcgattatatgccctctatgaaaaggtttcgcaaggaagaggaatcagagggcgctatttggtga

SEQ ID NO: 15683 - RNA, 9873 nt, synthetic construct
  misc_feature 1..9873: note = derived and/or modified CDS sequence (opt3) from DENV-3__AY876494__SS-prME
  source 1..9873: mol_type = other RNA
accagcctgtgcctcatgatgatgcttcccgccacactggctttccacttgacttccagagacggcgagcctaggatgatcgtggcaaagaacgaacgggggaaatctttactgtttaagacggcctcaggaattaatatgtgtaccctaatagcgatggatctcggtgagatgtgcgacgatacagtcacttacaaatgtccactgatcgctgaagttgagccggaagacattgattgctggtgtaaccttaccagtacatgggtgacctatggcacttgcaatcaggccggggagcatcgccgagacaagcgtagcgtagcactggccccccacgtgggaatgggcttggatacaagaacccaaacgtggatgtccgctgagggtgcatggaggcctgtcgaaaaagtggagacttgggccctccggcatccagggttcaccatcctggctctgtttctcgcccactacattggaacatctttaactcagaaggttgtgatcttcatactgcttatgttggtcaccccctcgatgacaatgcgctgtgtgggcgtaggcaacagagactttgttgaagggctgtcaggagcgacctgggtggatgtcgtgctagagcatggtggctgcgtgacgactatggcaaagaataaacctacactcgacatcgagctgcagaagaccgaagccactcagcttgctacactgaggaaattgtgtattgaggggaagatcaccaacgtcacgaccgatagccggtgcccaacacaaggagaagccattctccccgaggaacaggaccagaattatgtttgtaaacacacttacgtggatcgcggctggggtaacgggtgcggactgttcggcaagggcagtttagtaacctgcgcaaagtttcagtgtctggagcctatcgaggggaaagtggtccaacacgaaaatctcaagtatacagtgataattactgttcataccggagaccagcaccaggtgggtaacgacacacagggcgtcaccgtggagatcactccacaagcttccacggccgaagcgattcttccggagtacgggacactggtattggaatgctctccccgaaccggactagatttcaatgagatgatcctgctcactatgaaaaacaaggcctggatggttcatagacagtggtttttcgacctgcctcttccatggaccagcggcgcaacaaccgagactcccacatggaataggaaagaactgttggtgacgtttaagaacgctcacgccaaaaagcaggaggtcgtggtcctcggttcccaagaaggggctatgcacaccgccctgactggcgcaacagagatccagaattcaggaggcaccagtattttcgccgggcatttaaagtgtcggctgaaaatggataagctagaactcaaaggaatgagctatgctatgtgcctgaacacatttgtgcttaagaaagaggtttctgagactcagcacggtaccatattgatcaaggtggaatacaagggcgaggacgcgccttgtaaaattccattctccacggaagatgggcagggaaaggcacataacggccgtctgatcaccgccaatcccgtagtcacaaaaaaggaggagccggtgaacatagaagctgagcctcccttcggtgaatcaaatattgttatcgggatcggcgacaaagccctcaagattaactggtacaagaaaggaagcagtatcggcaagatgtttgaggcaactgcccgcggggctagaaggatggccattctgggagataccgcatgggacttcggttctgtgggcggggtccttaattccctgggaaaaatggtgcaccaaatatttggcagcgcgtatacagctttgttctcgggtgtatcttggatcatgaagattgggatcggcgtgctcctgacttggatcggattaaactccaaaaatacctcaatgagttttagctgcattgttataggcatcattacgctgtacctaggggccgtcgtgcaggcagatatgggatgtgtgatcaactggaagggcaaggaactcaaatgcggttccgggattttcgtcacaaatgaggttcatacctggactgagcagtataagtttcaggccgactctccaaaacggctggctacagccatcgcaggagcttgggaaaacggcgtgtgtggtatacgaagcaccactcgcatggagaatcttttgtggaagcaaatcgccaacgaactgaattacattctctgggagaacaatatcaaactgaccgtggtagtcggcgatattatcggggtgttagaacagggaaagagaacactgacgcctcagcccatggagcttaaatattcatggaagacctggggcaaggcgaaaatagttactgccgagacacagaacagttccttcattatcgacgggccaaacacccccgaatgccctagcgcttctagggcatggaatgtgtgggaggtcgaagactacggatttggcgtgttcacaactaacatttggttgaagctccgggaggtttatacccaatcatgtgatcaccgcctgatgagtgccgctatcaaagacgaaagagccgtgcacgcagatatgggttactggatagagagccagaagaatgggtcctggaaactagagaaggcgtcttttatcgaagtaaagacgtgcacatggccaaaatcgcataccctgtggagcaacggagtcctcgagtccgacatgattatcccgaagtcactggccggccccattagtcagcacaatcataggcctggttactatactcagaccgctggcccatggcaccttgggaaattggaactggatttcaactactgcgagggaacaactgtggtgatcaccgagaattgtggcacacgtgggccctctttacggacgaccactgtcagcggaaagctcatacacgaatggtgctgtcgatcctgcacactgcctccacttagatatatgggcgaggacggttgttggtacgggatggaaattaggcccatcaacgagaaagaagagaatatggttaagtcactggtgagcgccggatctggcaaggtagataactttaccatgggtgtgttgtgcctcgcaatcctgttcgaggaagtcatgcgcggcaaattcgggaagaaacatatgattgctggagtgctatttactttcgttctgctcctgtccggccaaatcacatggcgggacatggcccacacccttattatgatagggagtaatgcaagcgatagaacgggaatgggcgtgacttatttggccctgatcgctacctttaagattcagccgttcttagcgctcggttttttcctgaggaaacttacatctcgcgagaacctgctactcggggtcggactggccatggcaaccactttgcagctgcctgaagacatcgagcaaatggctaatggcattgccttaggcctcatgacactgaagcttatcacccagtttgaaacataccagctgtggactgccttggtgtccctcacctgttcaaacacgatattcacactgaccgttgcttggcgaactgcaaccctaatcctggccggggtgagtcttctcccactgtgccagagctcgtccatgcggaagacagattggttgcccatgactgtcgcggctatgggagtacctcccctgccattatttattttctctctcaaagacacccctaagcgtagaagctggcccctgaatgagggtgtgatggccgttggccttgtgtcaatcctggcaagttccttgctcaggaacgatgtcccaatggccgggccgctggtggctggaggcctactgattgcatgttatgtaatcacgggtacatctgccgaccttaccgtggagaaagcggctgacgtcacttgggaagaggaagccgagcaaacaggggttagccataacctcatgataaccgtggatgacgatggaactatgcgcattaaggacgatgaaacagagaatatccctaccgtgctgttgaaaacggcattactgatcgtctccggcatttttccctactcaataccagccactctcctggtgtggcacacctggcagaagcagacacagcggagcggcgttctttgggacgtacccagtcctccagagacccaaaaagctgaactggaggaaggggtgtacagaatcaagcagcagggaattttcggtaagacacaggtcggcgtgggggttcaaaaagagggagtgtttcatactatgtggcacgtcaccaggggcgccgtgttgacgcacaacggtaagcgactagagcccaattgggcatctgtaaaaaaggatctgatctcctatgggggaggctggcgcctcagcgctcagtggcagaaaggcgaagaggtccaagtgattgccgttgaacctgggaagaacccgaagaatttccagacaatgccaggaatcttccagactaccacaggtgagataggcgcgatcgccctggactttaaacccgggacctcgggatcacctattatcaaccgggaaggcaaggtggtcggtctttacgggaatggagtggttactaaaaacggcggctatgtgtctgggattgcacagaccaatgctgagccagatggacccacacctgagttagaagaggaaatgttcaagaaaagaaacctgacgatcatggacctccatccgggtagtggcaagactaggaagtacttgcccgccatagtccgtgaggctattaaacgccggctgagaaccctcatcctggcaccaacaagggtggtagccgccgaaatggaggaggctcttaaggggctgcctatccgatatcaaaccactgcgacaaaatccgaacacaccggacgggagattgtggatttgatgtgccatgcaacgtttactatgcgcctactgagccccgttagagtcccaaattacaacctcatcataatggacgaagcccacttcacagatcctgcttctattgccgcaaggggctatatcagcacccgggtgggtatgggggaggccgctgcgatttttatgaccgccactcccccaggaacagcagaagctttcccgcagtccaatgcccctatccaggacgaggagcgagacatacccgaaagatcatggaacagtggcaatgagtggattaccgattttgtgggcaagacagtctggttcgtaccaagcatcaaagcagggaacgacatcgccaactgtttacgcaagaatggaaagaaagtgattcagctgtctaggaagacttttgatacggaataccaaaaaacccgtcttaacgactgggatttcgttgtgacaactgacatctccgagatgggtgctaattttaaggccgatcgggtcattgaccccagaaggtgcctgaaacctgtgatactcaccgatggcccagagcgcgttatcttggcggggcccatgcctgtgacagcagcctcagctgcccagcgaagaggacgggtcggcaggaacccgcagaaggaaaatgaccagtacattttcaccggtcaaccactgaacaatgatgaggaccatgctcactggactgaagcaaagatgctcctggacaacatcaatacgcccgaggggatcattcctgcccttttcgaacccgagcgcgagaaaagtgctgccatagatggcgaatatcgtctaaagggagagagcagaaaaacctttgtggaactgatgcggaggggcgacttgccagtatggttagcacacaaggtggcgtccgaggggatcaaatacacagatcgcaagtggtgcttcgacggagaacgaaacaatcagattctggaggagaacatggatgttgaaatctggactaaagagggtgaaagaaagaagctccggcctaggtggctggacgcccgcacctattctgatccccttgctctgaaagagtttaaggacttcgccgcaggcagaaaatcgattgctctcgatttggtcacagaaatcgggagggtgccaagccatctggcccaccggacccgtaatgcactagacaacctggtgatgctccatacttcagagcacggaggccgcgcctaccgacacgctgtcgaggaacttcctgagacaatggaaacgctgttattgctgggtctcatgatactgcttaccgggggcgcgatgctgtttctcatctccggaaagggcattgggaaaactagtatcggattgatttgtgttatcgtgtctagcggtatgctgtggatggccgatgtaccgttacagtggatagcatccgctattgtgctagagttctttatgatggtcctgctcatccccgagccagaaaagcagagaacacctcaagacaatcagcttgcctatgtggttattggcatcctgaccttggccgcaatagtggctgccaacgagatggggctgctcgaaaccacaaagagggatctgggaatgtcaaaagagcccggcgtcgtatctccaactagctaccttgacgtggacctccatcctgcgagtgcttggacgctgtatgccgttgcaaccacagtgatcactcccatgttgcggcacaccattgaaaattccacagccaacgtcagcctggctgcaatcgccaaccaggcggtggtcttaatgggtctagataaggggtggccgatttctaaaatggacctgggcgtgccactccttgctctgggatgctactcacaagttaatcctttgaccctgactgccgcagtgctcctgcttgtaacgcattacgccatcataggccccgggttacaggctaaggccacacgcgaggcacagaaaagaaccgctgccggaattatgaagaacccaactgtggatggcatcatgaccatcgacctggatcccgtcatttatgactccaagttcgagaaacagctcggtcaagttatgttgctggtgctatgtgcggtccagctgctccttatgaggacaagttgggccctgtgcgaagcattgactctggctaccgggcctatcacaacgctctgggagggaagcccgggcaagttttggaataccactatagccgtgtcgatggcaaacattttccggggttcttacctggctggcgccgggttagccttttccatcatgaaaagcgtaggaacaggcaagcgagggaccggatcacagggcgaaactcttggtgagaaatggaagaagaaactgaatcagctcagtagaaaggaattcgatctatataaaaagtctgggattacagaggtggaccgcaccgaggcgaaagaaggactgaagaggggcgagacgacccaccatgctgtttcccggggtagcgcaaaattgcaatggtttgtggaacgtaacatggtcatccccgagggcagagtgatagatctggggtgtggaaggggcgggtggtcatactattgcgccggactcaagaaggtcacagaagtgcgcggctacactaaaggtgggccaggacacgaggagcctgttcccatgagtacctatggctggaatatcgtaaagcttatgagcggcaaagacgtgttctacctgcctccagaaaagtgtgatacattgctgtgcgacattggggagtcctctcccagccctactgtcgaagagtcccggaccatccgagtgctcaaaatggttgagccatggttaaagaacaatcagttctgtattaaggtgctgaacccctacatgccgacagtcatcgaacaccttgagagactgcagaggaaatatggaggtatgctagtgcgcaatcctctctcacggaactctacccatgaaatgtactggattagtaatggcactgggaacatcgtatcgagcgtgaatatggtttccagactgttgctgaaccgttttacgatgacacacaggcggccaaccatagagaaggatgtcgacctcggagctggcactcgccatgtgaacgccgaacccgagacccctaatatggacgtgattggtgagcgaatcaaaagaatcaaggaagagcactcttcaacatggcactatgatgacgaaaacccatacaaaacgtgggcatatcatgggagctacgaggtcaaggccaccggatccgctagttctatgattaatggcgttgtgaagcttctgactaaaccctgggatgtagtgccgatggtcacacagatggcgatgaccgacactacacctttcggccaacagagggtgtttaaggaaaaagttgatacccggacaccccgcccaatgcctgggactagaaaggtgatggagataaccgccgagtggttatggaggacgctgggacgaaacaaacggccccgtttgtgcaccagagaagagttcacaaagaaggtccgcactaatgcagctatgggtgccgtgtttaccgaagagaaccagtgggacagcgcaagggccgctgtagaagatgaggagttctggaatctctgggaccgggaaagagagctgcacaaactaggcaagtgtgggtcatgcgtttataacatgatgggaaaacgcgaaaagaaacttggcgagtttggtaaggccaaagggtccagggcgatctggtacatgtggctgggagcacgatacctcgagttcgaagccctgggctttttgaatgaggatcattggttcagtcgggaaaacagctattctggcgtggagggggaaggactgcacaagctcggttacattcttagagacatctccaagattccaggcggggctatgtatgccgatgacacagcaggatgggacactaggatcaccgaggatgacctgcataatgaggaaaaaataacgcaacagatggatcccgagcaccgccagttagctaacgccatctttaagctgacataccagaataaagtcgtgaaggtgcaacgtcctaccccaaaaggcactgtcatggacattatctcacggaaggatcagagaggtagcgggcaggttggaacatatggcttgaacaccttcactaatatggaagctcagctcgtgaggcaaatggagggcgaaggggtactgtcgaaggccgacctagagaacccgcaccttctggagaaaaagattaccccctggctcgaacctaaaggagtggagcgcctgaagcgaatggcaatctctggtgatgactgcgtcgtgaaaccaatagatgaccggtttgcgaacgccttgttagctctgaatgatatgggcaaggttagaaaggacattccccagtggcagcctagtaaagggtggcatgattggcagcaagtgccattctgttcccaccatttccacgaactcatcatgaaggacggaaggaaacttgtcgtgccctgccgccctcaggacgagctgatcggcagagcccggattagccagggtgcagggtggtcactaaaggaaacagcttgtctgggaaaagcctacgcacagatgtggtccctcatgtattttcacaggcgtgatttgcgactggcctctaacgcgatatgcagcgctgtaccggttcattgggtgccaacgagtcgcaccacttggtccatccacgcccatcaccaatggatgacaaccgaggacatgcttactgtctggaatagagtgtggattgaggataacccctggatggaagacaagacacctgttaccacgtgggaggatgtgccctacctgggcaagcgggaagaccagtggtgtggcagcctcatcgggttaacatctaggtcaacctgggcacagaatattctgactgccatccaacaggtccgcagtttgataggagatgaggagttcctggactacatgccatccatgaaaagatttcggaaggaagaggaaagcgagggtgctatctggtga

SEQ ID NO: 15684 - RNA, 9873 nt, synthetic construct
  misc_feature 1..9873: note = derived and/or modified CDS sequence (opt3) from DENV-3__AY923865__SS-prME
  source 1..9873: mol_type = other RNA
accagcctgtgcctcatgatgatgcttcccgccacactggctttccacttgacttccagagacggcgagcctaggatgatcgtggggaagaacgaacggggaaaatctttactgtttaagacggcatcaggtattaatatgtgtaccctaatagccatggatctcggcgagatgtgcgacgatacagtcacttacaaatgtccactgatcgcggaagttgagccggaagacattgattgctggtgtaaccttaccagtacatgggtgacctatgggacttgcaatcaggctggagagcatcgccgagacaagcgtagcgtagccctggcaccccacgtgggcatgggtttggatacaagaacccaaacgtggatgtccgccgagggggcttggaggcaggtcgaaaaagtggagacttgggcactccggcatcctggattcaccatcctggccctgtttctcgctcactacattggcacatctttaactcagaaggttgtgatcttcatactgcttatgttggtcaccccatcgatgacaatgcgctgtgtgggcgtagggaacagagactttgttgaaggactgtcaggtgccacctgggtggatgtcgtgctagagcatggcgggtgcgtgacgactatggcgaagaataaacccacactcgacatcgagctgcagaagaccgaagcaactcaacttgccacactgaggaaattgtgtattgagggaaagatcaccaacattacgaccggcagccggtgccctacacagggtgaagctatcctcccagaggaacaggatcagaattatgtctgtaaacacacttacgttgaccgcgggtggggaaacggctgcggcctgttcgggaagggaagtttagtgacctgcgccaagtttcaatgtctggagcccatagagggtaaagtagtgcagtatgaaaatctcaagtacacagtcattatcactgtgcacaccggcgatcagcctcaggttgggaacgacacacaaggagtgaccgtcgagattactccacaggcatccacggtggaagctgtacttctggagtatggcacattgggtctaaaatgctctccgcgaaccgggctggacttcaatgaaatgatcctcctgactatgaagaccaaagcctggatggttcatagacagtggtttttcgatcttcccctgccttggacaagcggcgcgaccactgagacaccaacgtggaacaggaaggagttgctcgtgacctttaaaaatgcccacgcaaagaagcaagaagtcgtggtcctgggatcccaggagggcgctatgcatactgccttaacaggggctaccgaaatccagaactcaggaggtacaagtattttcgccggccacctgaaatgtcggctaaagatggacaaactcgagctgaaggggatgagctacgcaatgtgccttaatacttttgtgttgaaaaaggaagtttctgagacccagcacggaacgatactgatcaaggtggagtacaaaggcgaagatgccccctgtaagattcctttctccaccgaggacggtcaagggaaagctcataacggccgtctcatcacagcgaacccagtagtcactaagaaagaagagcccgtgaatatagaggcagaaccgcctttcggagagtcaaacattgttatcggcatcggggataaggccctgaagattaattggtataaaaagggaagcagtatcggtaaaatgtttgaagctaccgcccgcggcgcaagaaggatggccattcttggggacacagcttgggatttcggatctgtgggcggtgtcctgaactccttggggaagatggtgcaccagatatttggcagcgcctacactgcactcttctcgggagtatcttggatcatgaaaattggcatcggggtgctgttaacctggatcggactgaattccaagaacacgtcaatgagttttagctgcattgttataggcatcattacactatatctcggtgcggtcgtgcaggctgacatggggtgtgtgatcaattggaagggaaaagagctgaagtgcggctccggtattttcgtcaccaacgaagttcatacttggacagagcagtacaaatttcaagccgattctcccaagcggcttgcaaccgccatcgctggcgcctgggagaatggggtgtgtggaatacgaagcactacccgcatggaaaacttgctgtggaaacagatcgcaaatgagctcaactatattctgtgggaaaataacatcaagttaacagtggtagtcggcgacattatcggggtgctggagcagggaaaaagaacgcttaccccacagcctatggaattgaagtactcatggaagacttggggcaaagctaagatagttacagccgagacccaaaatagttccttcattatcgatggtcccaacacaccagagtgccccagcgcgtctagggcctggaacgtgtgggaagtcgaggactatgggtttggagtgttcactaccaatatttggctcaaactgcgggaagtttacacgcagtcatgtgaccaccgcctaatgagtgctgcaatcaaggatgagagagccgtgcatgctgacatgggctactggatagaaagccagaaaaacggttcctggaagctggagaaggcctcttttatcgaggtaaaaacatgcacctggcctaagtcgcacactctctggagcaatggcgtcctggaatccgatatgattatcccaaaatcacttgcagggccgattagtcagcacaaccataggcccggatatcacacccaaacagcgggcccttggcatttggggaagctggagttagacttcaattactgcgaaggaactaccgtggtgatcacagagaactgtggcacgcgtggtccatctctccggaccactacagtcagcgggaaactgatacacgagtggtgctgtcgatcctgcacccttccccctctgagatatatgggagaagatggctgttggtacggtatggagattaggccaatcaatgaaaaggaggaaaacatggttaagtcattggtgagcgccggctctgggaaagtagacaattttactatgggagtgctctgcctggctatcctattcgaggaggtcatgcgcggcaagttcgggaaaaagcacatgattgccggagtgctgtttacattcgttctcctgctttccggccagatcacctggcgggatatggcacatacgttgattatgataggtagtaacgctagcgacagaatggggatgggagtgacttatctggccttaatcgcaacctttaaaattcagcccttcctcgccctgggctttttccttaggaagctgacatctcgcgaaaatctactcctgggcgtcgggttggctatggcgaccactctgcaattaccggaggatatcgaacagatggccaacggaattgcactcggtctgatgacacttaagctgatcacccagtttgagacataccagttgtggactgctctcgtgtccctgacctgttcaaatacgatattcacactaaccgttgcctggcgaactgccaccctgatccttgctggcgtgagtctcctgcctttgtgccaaagctcgtccatgcggaaaacagactggctgccaatgactgtcgcagccatgggggtaccccctttacccctctttattttctctctgaaggataccccaaaacgtagaagctggcctcttaacgaaggagtgatggcggttggcctggtgtcaatcttggctagttccctcctgaggaatgacgtccccatggccggtccactagtggcagggggactgcttattgcctgttatgtaatcacgggcacatctgctgatctcaccgtggagaaggcagccgacgtcacttgggaggaagaggcggaacagacaggcgttagccacaacctgatgataaccgtggacgatgacgggactatgcgcattaaagatgacgagacagaaaacatcttgaccgtgttactgaagacggctctcctgatcgtctccggaatttttccgtactcaatacctgccactcttctggtgtggcatacctggcagaaacagacacaacggagcggtgttttgtgggatgtacccagtccacccgagacccagaaggcagagctagaagagggcgtgtacagaatcaagcagcaggggattttcggaaaaacacaagtcggcgtgggtgttcagaaggaaggggtgtttcacactatgtggcatgtcaccaggggagccgtgctgacgcacaatggcaaacgactcgagcctaactgggcttctgtaaagaaagacctgatctcctatggcgggggatggcgccttagcgcccagtggcaaaagggtgaggaagtccaggtgattgcagttgagccaggcaagaatcccaaaaacttccagacaatgcctgggatcttccagactaccacaggagaaataggcgctatcgccttagattttaagccgggtacctcggggtcaccaattatcaatcgggagggaaaagtggtcggcctgtacggcaacggggtggttactaagaatggaggttatgtgtctggcattgcgcaaaccaacgccgaacccgacgggcctacaccagagctcgaggaagagatgttcaaaaagagaaatttgacgatcatggatctgcaccccggaagtggcaagactaggaaatacctccctgcaatagtccgtgaagctattaagcgccggctgagaacccttatcctggccccgacaagggtggtagctgcagagatggaagaggccttgaaaggtctacccatccgatatcagaccactgccacaaagtccgagcataccgggcgggaaattgtggacctgatgtgccacgctacgtttactatgcgcctcttaagcccagttagagtccctaactacaatctgatcataatggatgaggcgcatttcacagaccccgcatctattgccgctaggggatatatcagcacccgggtgggcatgggcgaagccgcagccatttttatgaccgctactccacctgggacagcggaggccttcccccagtccaacgcaccaatccaggatgaagagcgagacataccggagagatcatggaatagtggaaacgaatggattaccgactttgtgggtaaaacagtctggttcgtacctagcatcaaggctggcaatgatatcgccaactgtcttcgcaagaacgggaaaaaggtgattcaactgtctaggaaaacttttgacacggagtaccagaagacccgtctcaatgattgggacttcttggttacaactgatatctccgaaatgggagcaaactttaaagccgaccgggtgattgatcccagaaggtgcctgaagccagtcatactcaccgacggccccgagcgcgtgatcctggctggtcctatgccagttacagccgcgtcagcagcccagcgaagagggcgggtgggcaggaatccccagaaggagaacgatcaatacattttcaccggacagcctcttaataacgacgaagatcacgctcattggactgaggccaaaatgctactggacaatatcaacacgccggaaggcatcattccagctttgttcgagcccgaacgcgagaagagtgcagccatagacggggagtatcgtttaaaaggagaaagcagaaagacctttgtcgagctgatgcggaggggtgatctccctgtgtggctggctcacaaagtagcctccgaaggcatcaagtacacagaccgcaaatggtgcttcgatggggagcgaaataaccagattcttgaagagaatatggacgtggagatctggactaaggaaggagagagaaagaaactgcggcccaggtggctcgatgcacgcacctattctgacccattggcgctgaaggaatttaaagatttcgccgctggcagaaagtcgattgccctagacctggttacagagatcggtagggtccctagccacctcgcacatcggacccgtaacgctcttgataatctggtgatgttacacacttcagaacatgggggccgcgcctaccgacacgcagtggaggagttgcccgaaacaatggagacgctgctcctgcttggactgatgatactcttgaccggcggggccatgctgtttttaatctccggaaaaggtattggcaagactagtatcgggctaatttgtgtcatcgtttctagcggaatgctgtggatggctgacgtgccactccagtggatagcgtccgccattgtacttgaattctttatgatggtgctgttgatccctgagccggagaagcaaagaacaccccaggataaccagctggcatatgtcgtgattggcatcctcaccctggctgccatagttgccgcaaatgaaatgggtcttctcgagaccacaaaaagggacctggggatgtcaaaggaaccaggcgtggtctctcctactagctacttggatgtagacctgcaccccgctagtgcctggacgttatatgcggtggctaccacagttatcactccaatgctacggcataccattgagaactccacagccaatgtgagcctggcagccatcgctaaccaagcagtcgtgctcatgggacttgacaaaggctggcctatttctaagatggatctgggggtccccttgctggccctcggatgctactcacaggtgaacccgctgacccttactgcggctgttttactgctcgtgacgcactacgccatcataggcccaggtttgcaggcaaaagccacacgcgaagctcagaagagaaccgccgcagggattatgaagaatcctactgtagacggaatcatgaccatcgatctggaccccgtgatttatgattccaaattcgagaagcaactaggccaggtcatgctgctcgttctttgtgctgtgcagctgttgctgatgaggacaagttgggccctctgcgaggcgctgactttagccaccggtccaatcacaacgctttgggaaggcagccccgggaaattttggaacaccactatagcagtctcgatggctaatattttccggggatcttacctggccggcacagggctcgcattttccatcatgaagagcgtgggaaccggccgaagaggtactgggtcacagggagagacactaggcgaaaaatggaagaagaaactgaaccaattgagtcgcaaggagttcgacctgtataaaaagtctggtattaccgaagtagataggacggaggctaaagagggcctcaagcggggggaaaccacacatcacgccgtgtcccgtggaagcgccaaacttcagtggtttgttgagagaaatatggtgatccctgaaggcagggtcatagacctggggtgtggacgcggcggttggtcatactattgcgcggggttgaagaaggtgactgaggtccggggatacaccaaaggcggcccggggcatgaagagcccgtgccaatgagtacatatggatggaacatcgttaagctgatgagcggtaaagatgtattctacctccctcccgagaagtgtgacactttactgtgcgatattggcgaatcctctcctagcccaaccgtggaggaatcccgaacaatcagagtccttaaaatggtggagccctggctgaagaataaccagttctgtattaaggttctaaatccttacatgccaaccgtgatcgagcacctcgaaaggctgcagcgcaaatatgggggaatgttggtccggaaccccctgtcaagaaattctactcacgagatgtactggattagtaacggcacgggtaatatcgtgtcgagcgtaaacatggtgtcccgtctccttctgaataggtttacaatgacccatcggcgcccgactatagaaaaggacgttgatttaggggctggaacccgacacgtcaacgcagagcctgaaacaccaaacatggacgtgattggcgagagaatcaaaaggatcaaggaggaacattcttcaacgtggcactatgacgatgagaatccctacaaaacctgggcctatcacggcagctacgaagtgaaggctactgggtccgccagttctatgattaacggagtcgttaagctgttgacaaaaccttgggacgtggtaccaatggtgacccaaatggcaatgactgatacaacccccttcggtcagcagcgggtctttaaggagaaagtggacacacgcactccgagacctatgcccggcaccaggaaggttatggaaataacggccgagtggctctggcgaaccctggggcggaataaaaagccacgtctatgcacaagagaggaattcactaagaaagtgcgcaccaacgctgcgatgggagccgtctttacagaggaaaatcaatgggatagcgcaagggctgccgtggaggacgaagagttctggaagcttgtagatcgggagagagaactgcataaactcggcaagtgtggttcatgcgtttataacatgatggggaaacgcgagaagaaactgggagaatttggcaaggcaaagggctccagggccatctggtacatgtggttgggggctcgatacctggagttcgaggccctcggatttcttaatgaagaccactggttcagtcgggagaacagctattctggtgtggaaggcgaggggctgcataaattaggatacattctgagagatatctccaagattcctggcggtgcgatgtatgcagacgatactgccgggtgggacaccaggatcacggaagacgatttgcacaatgaggagaaaataacacagcagatggaccccgaacatcgccagctcgctaacgccatctttaagctgacctaccaaaataaagtcgtgaaggtgcagcgtccaactcccaagggaacagtcatggatattatctcacggaaagaccagagaggcagcggccaggttgggacctatggactaaacactttcaccaatatggaggcacaacttgtgaggcagatggaaggtgagggcgtactgtcgaaggctgatctcgaaaaccctcacctgttggagaaaaagattacacagtggttagagacgaaaggggtggaacgcctgaagcgaatggccatctctggagacgattgcgtcgtgaagccaatagacgatcggtttgctaatgccctccttgcactgaacgacatgggcaaagttagaaaggatattccgcagtggcaacccagtaaaggttggcacgactggcagcaggtgcctttctgttcccatcacttccatgagctaatcatgaaggatgggaggaaactggtcgtgccatgccgcccccaggacgaactcatcggaagagcgcggattagccaaggcgccggctggtcattgaaggagaccgcttgtctggggaaggcctacgcacagatgtggtcccttatgtattttcacaggcgtgacctgcgactcgcttctaacgccatatgcagcgcagtacctgttcactgggtgccaactagtcgcacaacctggtccatccatgcccaccatcagtggatgactacagaagatatgttaaccgtctggaatagagtgtggattgaggacaacccctggatggaggataaaacgcctgttacaacctgggaagacgtgccgtacctgggaaagcgggaggatcaatggtgtggtagcttgatcggcctgacttctagggcgacctgggctcagaatattctcacagccatccagcaggtccgctcacttataggggacgaagagttcctggattacatgccaagtatgaaaagatttcggaaggaggaagagtccgaaggagcaatctggtga

SEQ ID NO: 15685 - RNA, 9867 nt, synthetic construct
  misc_feature 1..9867: note = derived and/or modified CDS sequence (opt3) from DENV-4__KR922405__SS-prME
  source 1..9867: mol_type = other RNA
agcacaatcacactgctctgccttattcccactgtgatggccttccacctgtccacgagagacggagagcctttgatgatagtcgctaagcatgaaagagggcggccattactgtttaaaaccacagagggaatcaacaagtgtactttgattgcaatggatctcggtgaaatgtgcgaggacaccgttacatacaaatgtccgctgcttgtgaataccgaacccgaggatatcgactgctggtgtaacctgacttctgcctgggtaatgtatggaacatgcacccagtcaggggagcgccgacgtgaaaagagaagtgtggcgttgacgcctcacagcggaatgggcctcgagactagggctgaaacctggatgtcctctgagggtgcctggaaacatgcacaacgggtcgagtcgtggattctgcgcaatccagggttcgccctgctcgctggatttatggcatacatgatcggccagacaggcatacagagaactgtgttctttatcttaatgatgctggttgccccctcatatgggatgaggtgtgtgggagtcggtaaccgggatttcgtggaaggcgtaagcgggggagcttgggttgaccttgtgttggagcacggcggttgcgtcaccacaatggcccaggggaagcctaccctggattttgaactaattaagacgactgcgaaagaggtggcactcctgcgcacatactgtatcgaagccagtatttccaatatcaccactgctacacgatgcccaacccaaggagagccctatcttaaggaggaacaggaccagcagtacatatgtagaagggatatggtggaccggggctggggcaacgggtgcggactgttcggtaaaggcggggtcgttacgtgcgccaagttttcttgtttgggaaaaattaccggcaatctcgtgcaaatcgagaacctggaatatacagtagtggtcactgtgcataatggtgatacccacgcagttgggaacgacacaagcaatcacggcgtgactgctaccattacacctcgttccccatcagtcgaggtgaagttaccggattacggagaactgaccctcgactgcgagccccgcagtggcatcgacttcaacgagatgatccttatgaagatgaaaactaagacgtggctggtacataaacagtggtttttggatctacctctgccatggacaaccggggccgacactctcgaagttcactggaatcataaggagagaatggtgaccttcaaagtcccccacgcgaagaggcaggatgtgacagtcctgggaagccaggaaggtgccatgcactctgcacttgctggcgccaccgaggtggactccggggatggaaaccatatgtttgctggccacctgaaatgtaaggttcggatggaaaagttgcgaattaaaggtatgtcatacactatgtgcagcgggaagttcagtatagacaaagagatggccgagacacaacatggcacgaccgtggtaaaggtcaaatatgaaggaactggcgcaccttgtaaggtgccaatcgagattcgcgatgttaataaggaaaaagtggtcgggagaatcatatcttccacacccttcgccgagaacaccaacagcgtgacaaatattgagctcgaaccgccttttggagactcgtacatcgtaatcggtgtgggcgattctgctctgactttacactggttcaggaaggggtcctcaattggaaaaatgtttgagagtacctatcggggcgcgaagcgcatggcaatcctgggtgaaacggcctgggacttcgggagcgttggcggactactcacctccctgggcaaagctgtccatcaggtgtttgggtctgtgtacacaactatgttcggaggcgtcagctggatggttaggattcttataggtttgctggtgctctggatcgggaccaactcaaggaatacaagtatggccatgtcctgcattgcagtgggaggcatcactctgtttcttggtttcaccgtacacgccgatatgggctgtgtcgtgagctggtctgggaaggagctgaagtgcggatcaggcatctttgttattgacaacgtgcacacgtggacagaacagtataaattccaacccgagagtccagctcgtttggccagcgcaatactcaatgcgcataaggagggggtctgtggaatccggtccaccactcgactggaaaacgtgatgtggaaacagattacaaatgagttaaactacgttctgtgggaaggcggtcacgacctaaccgtggtagctggggatgtcaagggagtgctctctaaaggcaagagagccctggcacctcccgtgaatgaccttaagtattcgtggaaaacttggggtaaggccaaaatctttaccccagagacaaggaacagcacgttcttggtcgatggccccgacacctccgaatgccctaatgagcgccgggcttggaactttctggaggttgaagattacgggttcggaatgttcactacaaatatttggatgaagtttagagagggctcaagtgaagtgtgtgaccataggctcatgtctgccgcaatcaaagatcagaaggctgtacacgccgacatggggtactggatagagagctccaaaaaccagacctggcaaatcgaaaaggcgtcactgattgaggtgaagacatgcttatggccaaaaactcacaccctgtggagcaatggagtccttgagtctcagatgttgatcccgaaggcctatgctggccccatttcccagcataactaccgccagggttatgcaacgcaaacagccgggccttggcacctcggaaaactggaaatcgatttcggcgagtgcccaggtaccactgtgaccatacaggaagactgtgatcatcgaggccccagtctacggacaactaccgctagcgggaagctggttacacagtggtgctgtcgttcttgcacgatgcctccactcagatttctgggagaggacggctgttggtacgggatggagattaggccccttaacgaaaaagaggaaaatatggtgaagtcccaggtctcagccggacaaggcaccagtgagactttcagcatgggtttgctgtgcttaacactctttgtggaagagtgtctgcgccggagagttaccaggaagcacatgatccttgtggtcgtaactacactgtgcgcaattatcctaggcgggctcacctggatggatctgctacgagcgctgataatgctcggggacacgatgtcgggccgcatgggagggcagatccatctggccattatggctgtgttcaaaatgtccccgggttatgttcttggcatctttttgcggaagctgacttctagagagaccgccttaatggtgattgggatggcaatgacaaccgtcctcagcatccctcacgacctgatggagttcatagatggaatttcacttggcctgatcctactcaaaatggtgactcactttgacaacacacaggtaggtaccctggctttggccctgacattcatcaagagtactatgccattagtgatggcatggaggaccattatggccgtcctctttgttgtgacgctgatccccctttgtcgtacatcctgcctgcagaaacaatctcattgggtggagattaccgctttgatactcggggcgcaggccctgcctgtctacctaatgactctgatgaagggagcaagcaagcgctcctggccccttaatgaaggcatcatggctgtgggcctcgtttcactgttggggagcgccctgctaaagaacgatgtaccactcgccggacctatggtggctggtggcctgcttctggcagcctatgtcatgagtgggtcttccgcggacttgagcctcgagaaggctgccaatgtgcagtgggatgaaatggcagacattaccggatcgtcacccatcattgaggttaaacaagatgaggacggctctttcagtatccgggatgtggaagagacaaacatgataactctgctagtcaagctggcccttatcaccgtgtccggtctctacccactggctattccggtaacgatgacattgtggtacatgtggcaggtcaaaacccagagaagcggggcattatgggacgtgccttctcccgccgcggctcagaaggccactctgacagaaggagtttataggatcatgcaacgaggcctctttggcaagacccaggtgggggtcggcattcacactgagggtgtgttccatacaatgtggcacgttacccggggcagcgtgatctgtcatgaatccgggcgcctggagccatcatgggcagatgtcagaaatgacatgataagttacggaggcggttggaggcttggggataaatgggacaaggaggaagacgtgcaggtactggccattgagcccggcaaaaaccctaagcacgtgcagacgaaaccaggcttgttcaagactctaaccggcgaaatcggggctgttacactggattttaaacccggaaccagcggttctcctatcattaatcggaagggcaaggtcatagggctctatggaaacggcgtggtgacaaaatccggtgactacgtctcagccatcactcaagcagagcgaattggggagccggattatgaagtagacgaggatatcttcagaaagaaacgcctgaccattatggaccttcacccaggagctggcaagacgaaaaggatcttacccagtatagtgcgtgaagccctgaagcggagactcaggacattgatcctggcgcctactcgcgttgtggccgcagagatggaagaggctctccgaggcctgccaattagataccagacccccgccgtcaagagcgagcatacagggcgggaaatcgtggatcttatgtgccacgctacctttactaccaggctgttgtcctctacacgcgttcctaattataacctaattgtgatggacgaggcacatttcacggatccgtcgagcgtcgccgcccgtggatacatctcaactagagtggaaatgggtgaggctgcggcaatatttatgaccgccacacccccaggcaccactgaccctttcccccagtccaatagtccaattgaagatatcgagcgggagatccctgaaaggtcttggaacacagggtttgactggattaccgactaccagggaaaaacggtatggttcgtgcccagcatcaaggctggcaatgatatagccaactgcctgcgcaaatccggtaagaaagttattcaactctcacgaaagacttttgacacagagtatccaaagaccaaattaaccgattgggacttcgtcgtgactacagatatctctgaaatgggggcaaactttagagccggccgggtgattgacccgaggcgctgtctgaagcctgtcatccttaccgatggacccgagagagttatactggctggcccaattcccgtgacccctgcgagcgccgcacagaggcgggggcgtatcggacgcaatccagctcaggaagacgatcaatacgtattcagtggtgaccccctccgaaacgatgaggaccacgcccactggactgaggcaaaaatgttgctggataatatctatacgcctgaaggcattatcccgaccctcttcgggccagagagagaaaagacacaggccattgacggagagtttaggctgcggggcgagcagcgcaaaactttcgtggaacttatgagaaggggtgacctacccgtctggctgtcctacaaggtggctagcgccgggatatcttataaggatcgggagtggtgctttaccggcgaacgaaacaatcagatcttggaggaaaacatggaggttgagatttggacaagagaaggagagaaaaagaaattacgccctaagtggctggacgcgagggtgtacgcagatcccatggccctcaaagacttcaaggaatttgcttcaggccggaagtccatcaccctggatatccttactgagattgccagtctgccaatgtatctcagctcgcgtgctaaattggcactggacaatatagtcatgctacatacgaccgaaagagggggaaaggcctaccaacacgctctgaacgagctccctgagtctcttgaaacactgatgttagtagccttgctgggtgcaatgactgcgggcatcttcctctttttcatgcaggggaaaggaattggcaagctgtccatgggtcttatcgccattgctgtggccagcgggctgctctgggttgcagagatccagccccagtggatagctgcctcaatcattttggaatttttcctgatggtgctattagtcccagagcctgaaaaacaaaggaccccgcaggataatcagctgatctacgtgattctcacaatccttaccataattgcactggtcgccgctaacgagatgggcttgatcgagaagactaaaacagactttggattctatcaggtgaaggcggaaacgaccattctggatgttgacctccgccccgccagtgcatggactctgtacgctgtggccacaaccatccttaccccaatgctccggcatacaatagagaatacttctgccaacctgtccttggcagctatcgccaatcaagcggctgtactgatgggcttagggaagggatggcctctacaccgaatggatctgggcgtgcccctccttgccatgggttgttatagccaggtcaacccaacgaccctgacagcatcattggttatgctgctcgtgcattacgccattatcgggcctggactgcaggctaaagcaactagagaagcccagaagaggaccgcggctggcattatgaaaaatcccacagtcgacggtatcaccgtgatagatcttgagccgattagttatgacccaaagtttgagaaacaattaggccaggtaatgctgctcgtgttgtgcgccgggcagctgctactgatgcgcactacgtgggcattctgtgaagttctcacacttgccaccggacctatcctgactttgtgggagggcaaccccgggcggttctggaacaccacaatcgctgtgagcactgccaatatttttagaggatcctacctggcaggcgctggtctcgccttctctctgatcaagaacgcgcaaaccccacgtagggggacaggaacgaccggcgaaactttaggtgagaagtggaaacggcagcttaatagcctggaccgcaaggaatttgaggagtataaacgatccggcatactcgaagtcgatagaacagaggccaagtcagcactaaaagacgggtctaagattaagttcgctgtgagtaggggaacctcgaaaatccggtggattgtcgaacgcggcatggtgaagcccaaagggaaggttgtagatctgggatgcggcagaggtgggtggagctactacatggccactttgaaaaacgtgacagaggtcaagggatataccaagggcggccctgggcacgaagaaccggtgcccatggcaacgtacggatggaatctggttaaactccactccggtgtggacgtcttttataagccaaccgaacaggtggatacacttctgtgtgacatcggcgaatcttcaagcaaccctactatagaggaagggaggaccttgcgagtactgaaaatggtggagccctggctctccagtaagcctgagttctgcatcaaagttttaaatccatacatgcccacagtcattgaggagctggaaaaacttcagcggcgtcatggaggctctctggtgagatgtcctctaagccgcaactcaactcacgagatgtattgggtgtccggtgtcagtgggaatatcgttagctctgtgaacaccacatccaaaatgctcctgaataggtttaccactcggcatagaaagccaacgtacgaaaaggatgctgacttgggagccggcacacgctcagtaagcaccgagactgagaaacccgatatgaccattatcggcaggcgactgcaacggctccaggaagaacacaaggaaacatggcactatgaccatgagaacccgtacagaacgtgggcctaccacgggtcgtatgaagcgccttctaccggaagtgcttccagcatggtgaatggtgtcgtgaaacttctgactaagccatgggatgttgtgcccatggtcacacagttagcaatgaccgacactacacctttcggccagcaaagggtgtttaaagagaaggtagacacccgcacaccacagcccaagccggggactcgtgttattatgaccacgaccgccaactggctgtggacattgctcggacggaaaaagaatcctagactgtgcactagggaggagttcatctcaaaagtgcgctccaacgctgccataggcgcagtctttcaggaggaacagggttggacctctgccagcgaggctgtgaatgatagtcgattctgggagttagtggacaaggagcgggcgcttcatcaagaggggaaatgtgaatcctgcgtctacaacatgatgggaaagagagagaagaaactgggcgaatttggcagggccaaggggagccgcgcaatttggtatatgtggctcggagctagattcctggagttcgaagccttgggttttctgaacgaggatcactggttcggccgggaaaattcttggtcaggggttgaaggagagggcctccataggcttggttacatcctggaagacatcgataaaaaggacggggatttaatttatgcagacgatacagccggatgggacactcgtataaccgaggatgacctgttgaacgaggaactcatcacggagcagatggctccccaccacaaaattctggccaaggcgatctttaagctaacataccagaataaagtggtaaaggtgcttcgaccaacccctaaaggcgcagtcatggatattatcagtcgcaaggaccaaagaggctccggacaggtgggaacttatggtctgaacacattcaccaatatggaagttcagctcatacggcagatggaggccgaaggcgtgatcactcaagacgatatgcataaccccaaagggctgaaggagagggtcgagaaatggttgaaggaatgcggagtggaccgcttaaagagaatggctattagcggcgatgactgtgtagttaaaccactggatgagcggttttctacctcgctccttttcctgaatgacatgggtaaggtgaggaaagatatcccccagtgggaaccttcaaaggggtggaaaaactggcaggaggtcccattttgcagccaccatttccacaagatttttatgaaggacggacgatccctagtggttccgtgtcgtaatcaggatgaactgatcggcagagcccgcataagtcaaggcgcagggtggtctctccgggagacagcttgcttgggaaaagcctacgctcagatgtggagcctgatgtacttccacaggagagaccttcgcctggcctccatggcaatttgttcagcggtgcccacggagtggtttcctaccagtcggactacatggtctatccatgcccaccatcagtggatgaccactgaagatatgctcaaggtctggaacagggtgtggatcgaggacaatccaaacatgattgacaaaacacccgtacacagctgggaagatataccttatttaggtaagcgagaggacctgtggtgcggctccttgatcgggctgtcaagcagagctacctgggccaaaaatattcatacggcaatcacacaggtgcggaacctcattggaaaggaagagtacgtcgattatatgccagctatgaggcgctactctgcccacttcgagtccgaaggcgttctttga

SEQ ID NO: 15686 - RNA, 9867 nt, synthetic construct
  misc_feature 1..9867: note = derived and/or modified CDS sequence (opt3) from DENV-4__KP188557__SS-prME
  source 1..9867: mol_type = other RNA
agcaccatcactctgctctgccttattcccactgtgatggcattccacctgtccacgcgagacggcgaacctttgatgatagtcgctaagcatgaaagagggcggccattactgtttaaaaccacagaaggaatcaacaagtgtactctgattgcaatggatctcggtgaaatgtgcgaagacaccgttacatacaaatgtccgctgcttgtgaataccgaacccgaggatatcgactgctggtgtaacctgacttctacatgggtaatgtatggaacctgcacgcagtcaggggagcgccgacgtgaaaagcggagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcaggattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctcgcatattcaccccagaagcccggaacaatacttttctgatcgatggccccgacacatcggagtgccctaacgaaagaagggcatggaatagcttcgaggtggaggattacgggttcggaatgtttaccacaaacatttggatgaaattccgcgaaggctcctcagaggtatgtgaccatcgacttatgagtgctgccatcaaggatcagaaagcggtgcacgccgacatggggtattggattgaatctagcaagaatcaaacttggcagatcgagcgggcttccttgatagaagtcaaaacctgcctgtggccaaagacgcatacactctggtcaaacggagtgctggagagccagatgttaatcccgaagtcttacgcaggccccttttcccagcacaactatcgtcaaggttacgccacccagactgttgggccttggcacctgggaaaacttgagattgatttcggcgaatgcccaggtaccacagtgactatccaggagaattgtgaccatagaggccccagtttgaggaccacaacggctagcgggaagctcgtcacccagtggtgctgtcgctcttgcactatgcctccactgcggtttctaggagaagatggctgttggtatgggatggagattagacccctgtccgagaaagaagagaacatggtgaagtcacaagttacagccggacagggcaccagtgaaactttcagcatgggtctcctgtgccttacattgtttgtggaggaatgtctgaggcgacgcgtcacccggaaacacatgatcttagcagtagtgataacgctctgcgcgattatcctagggggacttacttggatggacctgttgagagccctcattatgctgggcgataccatgtcgggcaggatcgggggacagacacatctagctataatggccgttttcaagatgtccccgggttacgtgctgggcgtctttctccgtaagctgacctctcgcgagactgcacttatggtgatcgggatggctatgacaaccacattgagcattcctcacgacctgatggagttaatcgacggaatttcactcggcctgatccttctgaaaatagtaactcagttcgataatacccaagtgggtacgctagccctcagtctgacatttattcggtccaccatgtctttggtcatggcatggagaactatcatggccgttctgttcgtggtgaccttaatcccactctgtaggacaagctgcctgcagaagcagtcccattgggtcgaaattactgctcttatcctgggggcgcaagccttgcccgtgtatctcatgaccctgatgaaaggagcatcacgacggagctggcctctaaacgagggcattatggctgttggcctggtaagtcttctcgggtctgccctgttgaagaatgacgtgcccctggccggaccaatggtcgctggtggcttactcctggcagcctacgtgatgtccgggagctcggcggatctttcactggaaaaagctgccaacgttcgctgggacgagatggcagatataacgggatctagtcctatcattgaagtgaagcaggacgaggatggctcctttagcatcagagacgtcgaggaaacaaatatgattaccttgctcgtgaagctggccctaatcactgtatctggtctgtacccccttgctataccaatcacaatgaccctctggtatatgtggcaggtcaaaactcagaggagcggggcactgtgggatgtgccgtcccctgccgcgacacaaaaggctgccttgtcagagggagtttaccggattatgcagcgaggcttattcggcaaaacccaggtgggggtcggaatccacatggaaggtgtgttccacacgatgtggcatgttactagaggcagtgtgatttgtcacgagaccgggcgcctggaacccagctgggcagacgtcaggaacgatatgatctcttatggaggcggttggcgtctcggggacaagtgggataaagaggaggacgtgcaggtactggccatagaaccaggaaagaatcccaagcatgtgcaaacaaaacctggcctttttaagaccctgacaggcgagattggggctgttactttggacttcaaaccaggaacctccggttcacccatcatcaaccggaagggcaaagtcattgggctatacggaaatggcgtggtgacgaagagtggtgattatgtcagcgccataacacaggcagaaagaatcggggagcctgactacgaggtagatgaagacatttttaggaaaaagcgcctgactatcatggatctccacccgggagctggcaagaccaaacggattctgccatccatcgtgagagaggcccttaagagaaggttacgcacactgatactcgcgcccacccgtgttgtggccgcagaaatggaggaggctttgagaggcctgcctatccggtatcagactccagccgtcaaatctgagcataccgggagggagattgtggacctcatgtgccacgctacattcacgactcgcctgctttcgagcacccgagttcccaactacaatctgatcgtgatggatgaagcacactttacagacccttcatccgtcgccgccagaggatacattagtacccgggtggagatgggtgaagctgcggcaatcttcatgactgccacaccgcccggcgctaccgatccatttcctcagtctaacagccccatagaggacattgaaagggagatcccagagcgctcctggaatacggggttcgattggatcactgactatcaaggaaagacagtatggtttgtgccttcaattaaagccggcaacgacatcgcaaactgcttgagaaagtctggtaagaaagttatacagctaagcaggaagaccttcgataccgaataccccaaaactaagctgacagactgggattttgtcgtgaccacagacattagtgagatgggggccaatttccgggctggccgtgtgatcgatccacgccgatgtctcaaaccggtcattttaactgacgcgcctgaaagagttatcctggccggacccataccagtgacgcccgcatccgctgcccagaggcggggccgcattgggagaaaccctgcacaagaggatgaccagtatgtattcagcggagatccacttaagaatgacgaagatcatgcccactggaccgaggctaagatgctgctcgacaacatctacacacccgagggtatcattcctactttgtttggcccggaaagggagaaaacccaggccatcgatggggagttccggctgcgaggagagcagagaaagacatttgtggagctcatgcgcaggggcgacctgccagtctggctttcttataaagtggcgtcagcaggtatttcctacaaggaccgggaatggtgcttcaccggggagcgtaataaccaaatactagaagagaatatggaagttgagatctggactagagagggcgagaaaaagaagctgaggcccaaatggttggatgcccgcgtgtatgctgaccctatggccttaaaggattttaaagagttcgctagtggaagaaagagcattacgctggacatcctcaccgaaatcgcatcgctgcccacatacctttcttcccgagccaaactggctctcgataacattgtcatgttgcatactaccgagagaggcgggagggcctaccagcacgcactgaatgaactaccagagagcctggagacactcatgcttgtagcgctgttaggagccatgaccgctggtatatttttgttctttatgcagggcaaggggatcggaaagctgtcaatgggcctcattactatcgccgtggcaagtggtctgctttgggttgctgaaattcagcctcaatggatcgccgcatctataatcctggagttctttctcatggtgttgctgattcccgaaccagagaaacagcgcacacctcaggacaaccagttaatctatgtcattctaacgatcctgaccataattgggctcatcgccgctaatgaaatgggccttattgagaagactaaaacagatttcggattttaccaagtgaagaccgagaccacaatcctggacgtcgatttgcggccggcgtccgcctggactctgtatgcagtggctacgaccatactcacacccatgctgagacacactatcgaaaacaccagcgccaatctttcactcgccgcaattgctaaccaggccgcggttctgatgggcttggggaaaggatggccactgcatcgtatggacttaggcgtgcctctactggctatgggttgttacagtcaggtaaatcccacaaccctcactgccagccttgtgatgctgttggtccactatgcaatcattgggccaggactgcaggccaaggctacgagggaggcacaaaaacggacagccgcgggcatcatgaagaaccctaccgttgatggtataactgtgattgacctcgaacccatctcctacgatccgaagttcgagaaacagctgggccaggtcatgcttttagtgctgtgcgctgggcaactcttgctgatgcgcaccacatgggccttctgtgaggtactaactctggcaaccggaccaatcctcacactttgggaaggcaaccctgggcgattttggaatacgaccattgccgtgtctactgctaacatcttcagaggaagctatctggccggcgcaggtttggctttttccctgataaagaatgcccagacacccaggcgggggaccggaactgcgggcgagacactcggtgaaaaatggaagcgccagctgaactcattagacagaaaagagttcgaagagtacaagaggtctggcattcttgaggttgaccgaaccgaagccaagagtgcactgaaagatgggtcgaagatcaaacatgctgtgagccggggatcctctaagattcgttggatcgtcgagagaggcatggtgaaaccaaaggggaaggtcgtggacctcggatgcggccgcggtgggtggtcatactatatggccacgctcaaaaatgttaccgaagtaaagggatacacaaaaggcggccccgggcacgaggaacctataccgatggcaacttatggatggaacctggtgaagttgcatagcggtgtcgatgtgttttacaaacccaccgagcaggttgacacactgctctgtgatatcggcgagtccagttctaatccaactattgaagaggggaggacccttcgggtgctgaagatggtcgaaccttggttgagctcaaagcccgagttctgcatcaaagtgctgaacccttatatgccaacagtaattgaagaactagagaagttacaaagaaaacacggaggcaatctggtgcgctgtcccctttccaggaacagtacccacgaaatgtactgggttagcggtgcttctgggaatatcgtctcctcagtgaacactacgagcaagatgctgctaaatcgatttacaacccggcatagaaaacctacttatgagaaggacgtggatctcggagccggcaccaggtcggtctctacagaaacggagaaaccagacatgaccattatcggccgccgtctgcagcggttgcaggaggaacacaaggagacttggcattacgatcaggaaaacccctacagaacatgggcctatcacgggagttacgaggcgccgtccaccggaagcgcttcatccatggttaatggtgtggtaaagctgctcactaaaccttgggacgtgataccaatggtcacacaacttgcaatgaccgatacaactcccttcggccagcagagggtgtttaaggaaaaagttgacacccgcacgcctcagccaaagcccgggacccgaatggtgatgacaactaccgccaactggctgtgggctttactgggcaaaaagaagaatccgcggttgtgcacaagagaggagttcatttctaaagtcaggagcaacgccgcaatcggcgccgtgtttcaagaagaacagggttggacaagtgcttccgaagcggtaaacgacagccgcttctgggagctcgttgataaggaaagagccctgcaccaggaggggaaatgtgagtcttgcgtgtataatatgatgggaaagcgggagaaaaagctaggcgagtttggcagggcaaaggggtcacgtgctatctggtacatgtggcttggagcccgattcctggagttcgaggcactcggttttctgaacgaagaccattggttcggccgcgagaatagttggtccggggtcgagggagaaggcttgcacagactgggttatattctcgaggaaatagataaaaaggacggggatcttatgtacgccgacgataccgctggatgggacacgcggatcacagaggatgacctgcaaaacgaggaattaattaccgagcagatggcccctcatcacaaaatcctggcgaaggcaatttttaaattgacttatcagaataaggtggtgaaggtcctcaggcccacaccacgcggcgccgttatggatatcataagcagaaaagaccagcggggctctgggcaagtgggaacctacggtctgaacactttcaccaatatggaagtacagctaatcaggcagatggaggctgaaggcgtgattacacaggatgacatgcaaaaccctaaggggcttaaagagcgagtcgagaagtggctgcgtgaatgcggagtggacagactcaaacgcatggccatctcgggcgatgactgtgttgtgaagcccctggatgagcggtttggtacgtcattgttattcctgaatgacatggggaaagtcaggaaggatattccacagtgggaacccagcaagggatggaaaaactggcaggaggtgcctttttgctcccatcacttccacaagatctttatgaaagacggcagaagtctcgtagttccatgtcgcaatcaggatgaacttataggccgggcaaggatttctcaaggggctggatggagcctgcgagagaccgcctgcctaggtaaggcttacgcccagatgtggtccctgatgtatttccatagacgggacctcaggttggcatcaatggcgatctgtagtgccgtgccgactgagtggtttcccacatctcgcaccacttggagcatccacgctcatcaccagtggatgacaaccgaagatatgctgaaagtctggaaccgtgtgtggattgaggacaatcctaacatgatagataagacgccagttcactcctgggaagacatcccctaccttggcaagagagaggacctgtggtgcgggtcactcattggattaagctctcgagccacatgggccaaaaatatccataccgctattactcaggtgaggaacctgatcggcaaggaagagtatgtcgattacatgcctgtgatgaaacggtattccgccccaagtgagagcgaaggtgtattgtga

SEQ ID NO: 15687 - RNA, 9867 nt, synthetic construct
  misc_feature 1..9867: note = derived and/or modified CDS sequence (opt3) from DENV-4__KP188558__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcatgatggtgacactcacgccgtcgggaatgataccagcaaccacggcgtgacagcaaccattactcctcgttccccatcagtagaggttaagttaccggactacggagaactgacgctcgactgcgagccccgcagtggcatcgatttcaatgagatgattcttatgaagatgaaaaagaaaacatggctggtgcataagcagtggtttttggacctacctctgccatggaccactggggctgataccagcgaagtccactggaactacaaagagagaatggtgacattcaaggtcccccatgccaaaaggcaggacgtgaccgttctcggatctcaggaaggtgcgatgcactccgccctggcaggcgctactgaggtggattcaggggacggaaatcacatgtttgccggccatcttaagtgtaaggtacggatggaaaaactgcgaatcaagggtatgagctatacaatgtgcagtgggaaattctctatcgataaggagatggctgagacgcaacacggcaccactgtcgtgaaagttaagtacgaaggagccggcgcaccttgtaaggtgccaattgagatacgcgacgtcaacaaagaaaaggtggtagggagagtgatctccgccacacccttggctgagaataccaacagcgttacaaacattgagctcgaaccgcctttcggagattcgtatatcgtcataggtgtgggcaattctgcgctgactttacattggtttaggaaagggtcctcaattggaaagatgttcgagagtacctaccggggcgcaaaacgcatggccatcctgggtgaaacggcttgggactttgggagcgtgggcggactattcacctccctcggcaaggccgtccaccaggtttttgggtctgtgtatacaactatgttcggaggcgtgagctggatgatcagaattctgatcggttttcttgtattgtggattgggaccaactcaaggaatacaagtatggcaatgacttgcatagccgtcggaggcatcaccctgttcctcggttttacggtgcaggctgatatgggctgtgttgtgtcctggagcgggcgtgagctgaagtgcggatctggcattttcgtcgtggacaacgttcatacatggaccgaacaatacaaatttcagcccgagtcaccagcccggcttgcaagtgcgatcctgaatgctcacaaggacggggtgtgtggaatccgaagcactacaagattggagaacgtaatgtggaaacagattaccaatgaactcaactatgtcctgtgggagggcggtcacgatttaactgtggtggccggggacgtcaagggagttctgaccaaaggcaagagggcactaacacctcccgcctccgatctcaagtactcttggaaaacgtggggtaaggctaaaatattcaccccagaagcccgcaattcgacttttctgatcgacggccccgatacaagcgagtgccctaacgaacggagagcatggaattccttcgaggtggaggactacgggttcggaatgtttaccacaaacatttggatgaagttcagggaaggctcaagtgaggtatgtgatcatcgccttatgtctgctgccatcaaagaccagaaggcggtgcacgccgatatggggtattggattgaaagctccaaaaatcaaacttggcagatcgagcgagcttcattgatagaagtcaagacctgcctgtggccaaagacgcatacactctggagcaacggagtgctggagtctcagatgttaatcccgaaatcctacgcaggcccctttagtcagcacaattatcggcaaggttacgccacccagactgttgggccttggcacctgggaaagcttgagattgacttcggcgaatgcccaggtaccacagtgactatccaggagaactgtgatcatcgtggccccagcttgagaaccacaacggcttctgggaaactcgtcacccagtggtgctgtaggtcctgcactatgcctccactgcgctttctaggagaagacggctgttggtatgggatggagattcggcccctgtcagagaaggaagagaacatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggatctgttgcgggccctcattatgctgggcgacaccatgtccggcagaatcgggggacagacacatctagctataatggccgttttcaagatgtctccgggttacgtgctgggcgtctttctcaggaaactgaccagccgtgagactgcacttatggtgatcgggatggctatgacaaccacattgtcaattcctcacgacctgatggagttaatcgatggaattagtctcggcctgatccttctgaagatagtaactcagttcgacaatacccaagtgggtacgctagccctctccctgacatttattcgctctaccatcagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaacgagggcataatggctgttggcctggtatctcttctcgggtccgccctgttgaaaaatgatgtgcccctggccggaccaatggtcgctggtggcttactcctggcagcctacgtgatgagcgggtcgtcagcggacctttctctggaaaaggctgccaacgttcagtgggatgagatggcagacatcacgggaagttcccctattatcgaagtgaagcaggatgaggacggcagcttttctattcgggatgtcgaggaaacaaatatgatcaccttgctcgtgaaactggccctaataactgtaagcggtctgtacccccttgctatcccaattacaatgaccctctggtatatgtggcaggtcaagactcaacgctccggggcactgtgggacgtgccgtcacctgccgcgacacagaaagctgccttgagtgagggagtttacagaatcatgcagaggggcttattcggcaagacccaggtgggggtcggaattcacatggaaggtgtgttccacacgatgtggcatgttactcggggcagcgtgatctgtcacgagaccgggcgactggaaccctcttgggcagatgtcagaaacgacatgatatcctatggaggcggttggcgcctcggggataaatgggacaaggaggaggacgtgcaagtactggccattgaaccaggaaagaatcccaaacatgtgcagacaaagcctggcctttttaaaaccctgacaggcgagatcggggctgttactttggatttcaagccaggaacctcaggtagtcccatcattaacaggaaaggcaaggtcatagggctatacggaaatggcgtggtgacgaaaagcggtgactatgtctccgccatcacacaggcagaacgtattggggagcctgattacgaggtagacgaagatatctttcggaagaagagactgactattatggacctccacccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttatcagactccagccgtcaagtcggagcataccgggagagagatcgtggatctcatgtgccacgctacattcacgactcggctgcttagctcaaccagggttcccaactacaatctgattgtgatggacgaagcacactttacagatccttccagtgtcgccgcccgcggatacatctctacccgagtggagatgggtgaagctgcggcaatattcatgactgccacaccgcccggcgctaccgacccatttcctcaaagcaactcccccattgaggatatcgaaagagagatcccagagcggtcatggaatacggggttcgactggattactgactatcagggaaaaacagtatggtttgtgccttctatcaaggccggcaacgatatagcaaattgcttgaggaagagcggtaaaaaggttattcagctaagtcgcaaaaccttcgacaccgaataccccaagactaaactgacagattgggactttgtcgtgaccacagatatctccgagatgggggccaacttcagagctggcagggtgattgacccacggcgttgtctcaagccggtcatcttaactgatggacctgaacgcgttatactggcgggccccattccagtgacgcccgccagcgcagctcaacgaagagggaggatcggacggaaccctgcccaggaggacgatcagtatgtattctctggtgacccacttaagaatgatgaagaccatgcacactggaccgaggccaaaatgctgctcgataacatctacacacccgagggcattatccctactttgtttgggccggaacgcgagaagacccaggctattgacggagaattcagactgaggggcgagcaacggaaaacatttgtggagctcatgcgaagaggtgacctgccagtctggctttcatataaggtggcctccgcggggataagttacaaagatcgcgaatggtgcttcaccggcgagaggaataaccagatcctagaagagaatatggaagttgagatttggactcgggagggagaaaagaagaaactgcgtcccaagtggttggacgcaagagtgtatgccgatcctatggctttaaaagactttaaggagttcgccagcggcaggaaatcgatcacgctggatatcctcaccgaaattgcttctctgcccacatacctttccagccgcgcaaagctggccctcgacaacatagtcatgttgcatactaccgagcgggggggacgagcttaccagcacgccctgaatgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggataaccaattaatttatgtcatcctaacgatactgaccattatcggcctcattgcagccaatgaaatgggacttatcgagaaaactaagacagacttcggcttttaccaggtgaaaaccgagaccacaatactggatgtcgacttgaggccggctagcgcgtggactctgtatgccgtggcaacgaccatcctcacacccatgctgcgccacactattgaaaacacctcagctaatcttagtctcgccgccatcgcaaaccaggctgccgttctgatggggttgggaaagggctggccactgcatcggatggatttaggtgtgcctctactggcgatggggtgttacagccaggtaaatcccacaaccctcactgcttcccttgtgatgctgttggtccactatgccattatcggaccaggcctgcaagcaaaagccacgagagaggctcagaagcgtacagcagccggtataatgaagaaccctaccgttgacggcattactgtgatcgatctcgaacccatctcttacgacccgaaattcgagaagcagctggggcaagtcatgcttttagtgctgtgcgcgggacagctcttgctgatgaggaccacatgggctttctgtgaggtactaactctggccaccggcccaattctcacactttgggaagggaatcctggacggttttggaacacgaccatcgcagtgagcactgccaacatattccgcggctcctatctggctggtgccgggttggcattttcactgattaaaaatgctcagacaccccgaagaggaaccggcactgccggtgagacactcggcgaaaagtggaaaaggcagctgaactctttagaccggaaggagttcgaagagtacaagcgcagtgggatccttgaggttgatagaaccgaagcgaaatcggccctgaaggacggaagcaaaattaagcatgcagtgtccaggggctcttcaaaaatccgatggatagtcgagcgggggatggtgaagccaaagggaaaagtcgtggatctcggctgcggtcgtgggggatggagctactatatggctacgctaaagaatgttaccgaagtaaaaggctacacaaagggcgggcccggacacgaggaacctatcccgatggccacttatggttggaacctggtgaaattgcattccggcgtcgacgtgttttacaagcccaccgagcaagttgatacactgctctgtgacattggggagagttctagcaatccaactatcgaagagggaagaacccttcgcgtgctgaagatggtcgaaccttggttgtcatccaaacccgagttctgcattaaggtgctgaacccttatatgccaacagtaatcgaagagctcgagaaattacagaggaagcacggcggtaatctggtgcggtgtccccttagtagaaacagcacccacgaaatgtactgggtttctggggcatccggaaatattgtctcaagcgtgaacactacgtcgaaaatgctgctaaatcgctttacaaccaggcatcgaaagcctacttatgagaaagatgtggacctcggcgctggcacccggtctgtcagtacagaaacggagaagccagatatgaccatcatagggagaaggctgcagcgcttgcaggaggaacacaaggagacttggcattacgaccaagaaaacccctaccgtacatgggcctatcacggatcctacgaggccccgagcaccggttcagcgtcctctatggttaatggcgtggtaaaactgctcactaagccttgggatgtgattccaatggtcacacagcttgctatgaccgacacaactcccttcgggcagcagcgggtgtttaaagaaaaggttgacaccagaacgcctcaaccaaaacccggaaccaggatggtgatgacaactaccgcaaactggctgtgggccttactgggcaagaagaaaaatccgcgcttgtgcacacgagaggagttcatcagcaaggtccggagtaacgctgccatcggtgcagtgtttcaggaagagcaggggtggacttccgccagcgaagctgtaaatgattctagattctgggagctcgttgacaaagaaagggcgctgcaccaagagggaaagtgtgagtcatgcgtgtataacatgatgggcaaacgcgaaaagaagctaggcgagtttgggagagccaaaggaagtcgggcaatttggtacatgtggcttggtgctaggttcctggaattcgaggccctcggctttctgaacgaagatcattggttcgggcgtgagaattcctggagcggagtcgagggcgaaggtttgcaccgactggggtatatactcgaggaaatcgacaagaaagatggagaccttatgtacgcagatgacaccgccggctgggatacgcgcattacagaggacgatctgcagaacgaggaattaatcaccgagcagatggctcctcatcacaagattctggccaaagcgatctttaagttgacttatcagaataaggtggtgaaagtcctcagacccacaccacggggcgcagttatggacataatctctaggaaggatcaacgcgggtcgggacaggtgggtacctacggcctgaacactttcaccaatatggaagtacagctaattagacagatggaggccgaaggggtgatcacacaagacgacatgcagaaccctaaaggacttaaggagcgggtcgagaaatggctgagggaatgcggcgtggatcgactcaagcgtatggctatttcaggtgacgattgtgttgtgaaacccctggacgagagatttgggacgagcttgttattcctgaatgatatgggaaaggtccgcaaggacatcccacagtgggaaccctccaaaggctggaagaactggcaggaggtgcctttttgcagtcatcacttccacaaaatatttatgaaggatggccggtctctcgtagttccatgtaggaatcaagacgaacttattgggagagcccgcatcagccagggagcaggttggtccctgcgggagaccgcttgcctaggcaaagcctacgctcagatgtggtcactgatgtatttccataggcgagatctcagattggccagtatggcaatctgttctgcggtgccgactgagtggtttcccacaagccggaccacttggtccattcacgcccatcaccagtggatgacaaccgaagacatgctgaaggtctggaacagggtgtggatagaggataatcctaacatgatcgacaagacgccagttcactcatgggaagacattccctaccttgggaaacgcgaggatctgtggtgcggaagcctcatcggcttatcttcccgtgctacatgggccaagaatattcataccgcaatcactcaagtgagaaacctgataggtaaagaagagtatgtcgactacatgcctgtgatgaagcgatatagtgctccaagcgagtcggaaggggtattgtga

SEQ ID NO: 15688 - RNA, 9867 nt, synthetic construct
  misc_feature 1..9867: note = derived and/or modified CDS sequence (opt3) from DENV-4__KP188563__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatgctgggcgataccatgtccggcagaatcgggggacagacacatctagctataatcgccgttttcaagatgtctccgggttacgtgctgggcgtctttctcaggaaactgaccagccgtgagactgcacttatggtgattgggatggctatgacaaccacattgtcaatccctcacgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccaattacaatgaccctctggtatatgtggcaggtcaagactcaacgctccggggcactgtgggatgtgccgtcacctgccgcgacacagaaagctgccttgagtgagggagtttacagaatcatgcagaggggcttattcggcaagacccaggtgggggtcggaattcacatggaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggatagggaggaggacgtgcaagtactggccattgaaccaggaaagaaccccaagcatgtgcagacaaaacctggcctttttaagaccctgacaggcgagatcggggctgttactttggacttcaaaccaggaacctcaggtagtcccatcattaatcgtaagggcaaagtcatagggctatacggaaacggcgtggtgacgaagagcggtgattatgtctccgccatcacacaggcagaacggattggggagcctgactacgaggtagatgaagacatctttagaaaaaagaggctgactattatggatctccacccgggagctggcaagaccaaacgcatcctgccatctatagtgcgagaggcccttaagagacggttaaggacactgatcctcgcgcccacccgcgttgtggccgcagaaatggaggaagctttgcgtggcctgcctattagatatcagactccagccgtcaaatcggagcataccgggcgggagatcgtggacctcatgtgccacgctacattcacgactaggctgcttagctcaacccgcgttcccaattacaacctgattgtgatggatgaagcacactttacagacccttccagtgtcgccgcccgaggatacatctctaccagagtggagatgggtgaagctgcggcaatattcatgactgccacaccgcccggcgctaccgatccatttcctcaaagcaattcccccattgaggacatcgaacgggagatcccagagaggtcatggaacacggggttcgattggattactgactatcagggaaagacagtatggtttgtgccttctatcaaagccggcaatgacatagcaaactgcttgcgcaagagcggtaagaaagttattcagctaagtagaaagaccttcgataccgaataccccaaaactaagctgacagactgggattttgtcgtgaccacagacatctccgagatgggggccaacttcagggctggccgggtgattgatccacgtcgctgtctcaaaccggtcatcttaactgacggacctgaacgagttatactggcgggccccattccagtgacgcccgccagcgcagctcaaagaagggggcggatcggacgcaatcctgcccaggaggatgaccagtatgtattctctggtgatccacttaagaacgacgaagatcatgcacactggaccgaggccaagatgctgctcgacaatatctacacacccgagggcattatccctactttgtttgggccggaaagagagaaaacccaggctattgatggagaattcaggctgcggggcgagcaacgaaagacatttgtggagctcatgagacgcggtgacctgccagtctggctttcatataaagtggcctccgcggggataagttacaaggacagggaatggtgcttcaccggcgagcggaacaatcagatcctagaagagaacatggaagttgagatttggactcgtgagggagaaaaaaagaagctgagacccaaatggttggatgcaagggtgtatgccgaccctatggctttaaaggattttaaagagttcgccagcggccgcaagtcgatcacgctggacatcctcaccgaaattgcttctctgcccacatacctttccagccgggcaaaactggccctcgataatatagtcatgttgcatactaccgagcgagggggaagagcttaccagcacgccctgaacgaactaccagagtcactggagacactcatgcttgtagcactgttaggtgcgatgaccgccggcatctttttgttctttatgcaggggaagggaattggcaagctgagtatgggtctcatcactattgctgtggcctctgggctgctttgggttgcagaaatccaacctcagtggatagctgcctccatcattctggagttctttctcatggtgttgctgatccccgaaccagagaaacagaggacacctcaggacaatcaattaatttatgtcatcctaacgatactgaccattatcggcctcattgcagccaacgaaatgggacttatcgagaagactaaaacagatttcggcttttaccaggtgaagaccgagaccacaatactggacgtcgatttgcgcccggctagcgcgtggactctgtatgccgtggcaacgaccatcctcacacccatgctgcggcacactattgaaaatacctcagctaaccttagtctcgccgccatcgcaaatcaggctgccgttctgatggggttgggaaaaggctggccactgcatagaatggacttaggtgtgcctctactggcgatggggtgttacagccaggtaaaccccacaaccctcactgcttcccttgtgatgctgttggtccactatgccattatcggaccaggcctgcaagcaaaggccacgcgtgaggctcagaaaaggacagcagccggtataatgaagaatcctaccgttgatggcattactgtgatcgacctcgaacccatctcttacgatccgaagttcgagaaacagctggggcaagtcatgcttttagtgctgtgcgcgggacagctcttgctgatgcggaccacatgggctttctgtgaggtactaactctggccaccggcccaattctcacactttgggaagggaaccctggacgcttttggaacacgaccatcgcagtgagcactgccaatatattccgaggctcctatctggctggtgccgggttggcattttcactgattaagaacgctcagacacccagaaggggaaccggcactgccggtgagacactcggcgaaaaatggaagcggcagctgaattctttagaccgcaaagagttcgaagagtacaagagaagtgggatccttgaggttgacaggaccgaagcgaagtcggccctgaaagatggaagcaagattaaacatgcagtgtcccgaggctcttcaaagatccggtggatagtcgagcgtgggatggtgaaaccaaagggaaaggtcgtggacctcggctgcggtagagggggatggagctactatatggctacgctaaaaaacgttaccgaagtaaagggctacacaaaaggcgggcccggacacgaggaacctatcccgatggccacttatggttggaatctggtgaagttgcattccggcgtcgatgtgttttacaaacccaccgagcaagttgacacactgctctgtgatattggggagagttctagcaacccaactatcgaagagggacgcacccttagggtgctgaagatggtcgaaccttggttgtcatccaagcccgagttctgcattaaagtgctgaatccttatatgccaacagtaatcgaagagctcgagaagttacagcggaaacacggcggtaacctggtgagatgtccccttagtcgcaatagcacccacgaaatgtactgggtttctggggcatccggaaacattgtctcaagcgtgaatactacgtcgaagatgctgctaaacaggtttacaacccgacatcggaaacctacttatgagaaggacgtggatctcggcgctggcaccagatctgtcagtacagaaatcgagaaaccagacatgacgataattgggaggcgcctgcagcgtttgcaggaggaacacaaggagacctggcattacgatcaagaaaatccctaccggacttgggcctatcacggatcctacgaggccccgagcacaggttcagcgtcctctatggttaacggcgtggtaaagctgctcaccaaaccttgggacgtgatcccaatggtcactcagcttgctatgacagataccacacccttcgggcagcagagagtgtttaaggaaaaagttgacactaggacccctcaaccaaagcccggaacgcgcatggtgatgaccacaactgcaaattggctgtgggccttactgggcaaaaagaagaacccgcgattgtgcacccgggaggagttcatcagcaaagtcagaagtaatgctgccattggtgcagtgtttcaggaagagcaggggtggacatccgccagcgaagctgtaaacgactctaggttctgggagctcgttgataaggaacgcgcgctgcaccaagagggaaaatgtgagtcatgcgtgtataacatgatgggcaagagagaaaaaaagctaggcgagtttgggcgggccaagggaagtagggcaatatggtacatgtggcttggtgctcgtttcctggaattcgaggccctcggctttctgaatgaagaccattggttcgggcgagagaactcctggagcggagtcgagggcgaaggtttgcaccgcctggggtatatcctcgaggaaattgataaaaaggacggagatcttatgtacgcagacgatactgccggctgggacaccagaatcacggaggatgacctgcagaatgaggaattaattacagagcagatggctcctcatcacaaaatcctggccaaggcgatatttaaattgacctatcagaacaaggtggtgaaggtcctccggcccactccaaggggcgcagttatggatatcatttctcgcaaagaccaaagagggtcgggacaggtgggtacatacggcctgaataccttcactaacatggaagtacagctaatccggcagatggaggccgaaggggtgattacccaagatgacatgcagaatcctaagggacttaaagagagggtcgagaagtggctgcgagaatgcggcgtggaccgtctcaaaagaatggctatctcaggtgatgactgtgttgtgaagcccctggatgagcgctttgggacaagcttgttattcctgaacgacatgggaaaagtccggaaggatataccacagtgggaaccctccaagggctggaaaaattggcaggaggtgcctttttgcagtcatcacttccacaagatttttatgaaagacggcaggtctctcgtagttccatgtagaaaccaagatgaacttatcgggcgcgcccggatcagccagggagcaggttggtccctgagggagacggcttgcctaggcaaggcctacgctcagatgtggtcactgatgtatttccatcgaagagacctccggttggccagtatggcaatttgttctgcggtgccgaccgagtggtttcccactagcaggacaacctggtccatacacgcccatcaccagtggatgactacagaagatatgctgaaagtctggaatcgcgtgtggatcgaggacaaccctaatatgattgataagaccccagttcactcatgggaagacatcccctaccttgggaagcgtgaggacctgtggtgcggaagcctcattggcttatcttccagagctacgtgggccaaaaacatccatacagcaataacccaagtgcgaaatctgatcggtaaggaagagtatgtcgattacatgagtgtgatgaaaaggtatagcgctccttcggagtccgaaggggtattgtga

SEQ ID NO: 15689 - RNA, 9867 nt, synthetic construct
  misc_feature 1..9867: note = derived and/or modified CDS sequence (opt3) from DENV-4__KP188564__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatcgctcaggggaagcctacgctggattttgaactaactaagacaaccgccaaagaggtggcgctcctgcgcacttactgtattgaagcacttatcagtaatattacaaccgccacgcgatgcccaacccaaggagagccctatctgaaggaggaacaggaccagcagtacatctgtagaagggatgtcgttgaccggggctggggcaacgggtgcggattgttcggtaaaggcggggtggtaacatgcgctaagttttcctgttctggaaaaataactggcaatctcgtgcaaattgagaacctggaatataccgtcgtggttacagtgcataatggtgatactcacgccgtcgggaacgacaccagcaatcacggcgtgacagcaaccatcactcctcgttccccatcagtagaggttaagttaccggattacggagaactgacgctcgactgcgagccccgcagtggcattgacttcaacgagatgatccttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctattgacaaggagatggctgagacgcaacacggcaccactgtcgtgaaaataaagtacgaaggagccggcgcaccttgtaaggttccaatcgagattcgcgatgtgaataaagaaaaggtcgtggggagagtaatctccgccacacccttggctgagaacaccaacagcgtgacaaatatagagctcgaaccgcctttcggagactcgtatattgttatcggtgtcggcaactctgcgctgactttacattggtttaggaaagggtcctcaatcggaaagatgttcgagagtacctaccggggcgcaaaacgcatggccattctgggtgaaacggcttgggattttgggagcgtgggcggactattcacctccctcggcaaggccgtgcaccaggtctttgggtctgtttatacaactatgttcggaggcgtgagctggatgatcagaattctgataggttttcttgtgttgtggatcgggaccaattcaaggaacacaagtatggcaatgacttgcattgccgtaggaggcatcaccctgttcctcggttttacggtccaggctgacatgggctgtgtggtttcctggagcgggcgtgagctgaagtgcggatctggcatcttcgtggtcgataatgtgcatacatggaccgaacaatacaaatttcagcccgagtcaccagcccggcttgcaagtgcgattctgaacgctcacaaggacggggtttgtggaatacgaagcactacaagattggagaatgtgatgtggaaacagatcaccaacgaactcaattatgtactgtgggagggcggtcacgacttaactgtcgtggccggggatgtgaagggagtcctgaccaaaggcaagagggcactaacacctcccgcctccgacctcaagtactcttggaaaacgtggggtaaggctaaaattttcaccccagaagcccgcaactcgacttttctgatcgatggccccgacacaagcgagtgccctaatgaacggagagcatggaactccttcgaggttgaggattacgggttcggaatgtttaccacaaatatttggatgaagttcagggaaggctcaagtgaggtgtgtgaccatcgccttatgtctgctgccatcaaagatcagaaggcggtacacgccgacatggggtattggatagaaagctccaaaaaccaaacttggcagatcgagcgagcttcattgattgaagtgaagacctgcctgtggccaaagacgcatacactctggagcaatggagtcctggagtctcagatgttaatcccgaaatcctacgcaggcccctttagtcagcacaactatcggcaaggttacgccacccagactgtggggccttggcacctgggaaagcttgagattgatttcggcgaatgcccaggtaccacagttactatccaggagaactgtgaccatcgtggccccagcttgagaaccacaacggcttctgggaaactcgtgacccagtggtgctgtaggtcctgcactatgcctccactgcgctttctaggagaagatggctgttggtatgggatggagatacggcccctgtcagagaaggaagagaatatggtcaaaagtcaagtgacagccggacagggcaccagcgaaactttctcgatgggtctcctgtgccttacattgtttgttgaggaatgtctgagaaggcgagtgacccgcaagcacatgattttagcagtcgtaatcacgctctgcgcgattatcctggggggacttacttggatggacctgttgcgggccctcataatgctgggcgataccatgtccggcagaatcgggggacagacacatctagctattatggccgtgttcaagatgtctccgggttacgttctgggcgtgtttctcaggaaactgaccagccgtgagactgcacttatggtcatcgggatggctatgacaaccacattgtcaattcctcacgacctgatggagttaatcgacggaataagtctcggcctgattcttctgaagatcgtgactcagttcgataacacccaagtaggtacgctagccctctccctgacatttatccgctctaccatgagcttggtgatggcatggcggactattatggccgtcctgttcgttgtgaccttaatcccactctgtagaacatcctgcctgcagaaacagtcacattgggtggaaattactgctcttatactgggggcgcaagccttgcccgtctatctcatgaccctgatgaagggagcaagcaggcgaagttggcctctaaatgagggcatcatggctgtgggcctggtttctcttctcgggtccgccctgttgaaaaacgacgtacccctggccggaccaatggtggctggtggcttactcctggcagcctacgtcatgagcgggtcgtcagcggatctttctctggaaaaggctgccaatgtgcagtgggacgagatggcagatattacgggaagttcccctatcattgaagttaagcaggacgaggatggcagcttttctatccgggacgtggaggaaacaaacatgataaccttgctcgtcaaactggccctaatcactgtgagcggtctgtacccccttgctattccaatcacaatgaccctctggtatatgtggcaggtaaagactcaacgctccggggcactgtgggatgtcccgtcacctgccgcgacacagaaagctgccttgagtgagggagtgtacagaattatgcagaggggcttattcggcaagacccaggttggggtgggaatccacatggaaggtgtcttccacacgatgtggcatgtgactcggggcagcgttatatgtcacgagaccgggcgactggaaccctcttgggcagacgtgagaaatgatatgatttcctatggaggcggttggcgcctcggggacaaatgggataaggaggaggacgtccaagtgctggccatcgaaccaggaaagaaccccaaacatgtacagacaaagcctggcctttttaaaaccctgacaggcgagatcggggctgtgactttggacttcaagccaggaacctcaggtagtcccattataaataggaaaggcaaggttatcgggctatacggaaacggcgtcgtgacgaaaagcggtgattatgtgtccgccattacacaggcagaacgtatcggggagcctgactacgaggtcgatgaagacatttttcggaagaagagactgactatcatggatctccacccgggagctggcaaaaccaagaggatactgccatctatcgtacgcgaggcccttaaacgaagattacggacactgattctcgcgcccaccagggtggttgccgcagaaatggaggaagctttgcgcggcctgcctatccgttatcagactccagccgtgaagtcggagcataccgggagagagattgtcgacctcatgtgccacgctacattcacgactcggctgcttagctcaaccagggtgcccaattacaacctgatcgttatggatgaagcacactttacagacccttccagtgtggccgcccgcggatacatatctacccgagtcgagatgggtgaagctgcggcaattttcatgactgccacaccgcccggcgctaccgatccatttcctcaaagcaattcccccatcgaggacatcgaaagagagattccagagcggtcatggaacacggggttcgattggatcactgactatcagggaaaaacagtgtggtttgtaccttctataaaggccggcaatgacattgcaaactgcttgaggaagagcggtaaaaaggtgatccagctaagtcgcaaaaccttcgataccgaataccccaagactaaactgacagactgggattttgttgtcaccacagacatttccgagatgggggccaacttcagagctggcagggtgatcgatccacggcgttgtctcaagccggtgatattaactgacggacctgaacgcgtcattctggcgggccccatcccagttacgcccgccagcgcagctcaacgaagagggaggatcggacggaatcctgcccaggaggatgaccagtatgtgttctctggtgatccacttaagaacgacgaagatcatgcacactggaccgaggccaaaatgctgctcgacaatatttacacacccgagggcatcattcctactttgtttgggccggaacgcgagaagacccaggctatagatggagaattcagactgaggggcgagcaacggaaaacatttgtagagctcatgcgaagaggtgacctgccagtgtggctttcatataaggtcgcctccgcggggatcagttacaaagaccgcgaatggtgcttcaccggcgagaggaacaatcagattctagaagagaacatggaagtggagatctggactcgggagggagaaaagaagaaactgcgtcccaagtggttggatgcaagagtttatgccgaccctatggctttaaaagattttaaggagttcgccagcggcaggaaatcgatcacgctggacattctcaccgaaatagcttctctgcccacatacctttccagccgcgcaaagctggccctcgataatatcgtgatgttgcatactaccgagcgggggggacgagcttaccagcacgccctgaacgaactaccagagtcactggagacactcatgcttgtcgcactgttaggtgcgatgaccgccggcatttttttgttctttatgcaggggaagggaatcggcaaactgagtatgggtctcattactatcgctgtagcctctgggctgctttgggtggcagaaatacaacctcagtggatcgctgcctccattatcctggagttctttctcatggttttgctgattcccgaaccagagaagcagagaacacctcaggacaatcaattaatctatgtgatactaacgattctgaccatcattggcctcatcgcagccaacgaaatgggacttatagagaaaactaagacagatttcggcttttaccaggtcaaaaccgagaccacaatcctggacgtggatttgaggccggctagcgcgtggactctgtatgccgtcgcaacgaccattctcacacccatgctgcgccacactatcgaaaatacctcagctaaccttagtctcgccgccattgcaaatcaggctgccgtgctgatggggttgggaaagggctggccactgcatcggatggacttaggtgttcctctactggcgatggggtgttacagccaggtgaaccccacaaccctcactgcttcccttgtaatgctgttggtgcactatgccatcataggaccaggcctgcaagcaaaagccacgagagaggctcagaagcgtacagcagccggtattatgaagaatcctaccgtcgatggcatcactgttatcgacctcgaacccatttcttacgatccgaaattcgagaagcagctggggcaagtgatgcttttagtcctgtgcgcgggacagctcttgctgatgaggaccacatgggctttctgtgaggtgctaactctggccaccggcccaacactcacgctttgggaagggaaccctggacggttttggaacaccactatcgcagtaagcacagccaatatattccgcggctcctatctggctggtgccgggttggcattttcactgattaaaaacgctcagaccccccgaagaggaactggcacagccggtgagaccctcggcgaaaagtggaaaaggcagctgaattctttagaccggaaggagttcgaagagtacaagcgcagtgggatccttgaggtggacagaacggaagcgaaatcggccctgaaggatggaagcaaaattaagcatgcagtttccaggggctcttcaaaaatccgatggatagtggagcgggggatggtcaagccaaagggaaaagtggtcgacctcggctgcggtcgtgggggatggagctactatatggctaccctaaagaacgtgacagaagttaaaggctacactaagggcgggcccggacacgaggaacctatcccgatggccacctatggttggaatctggtaaaattgcattccggcgtggatgtcttttacaagcccacagagcaagtggacactctgctctgtgatattggggagagttctagcaacccaaccatcgaagagggaagaacacttcgcgttctgaagatggtggaaccttggttgtcatccaaacccgagttctgcattaaggtcctgaatccttatatgccaaccgtgatcgaagagctcgagaaattacagaggaagcacggcggtaacctggtacggtgtccccttagtagaaatagcactcacgaaatgtactgggtgtctggggcatccggaaacattgtttcaagcgtcaatacgacatcgaaaatgctgctaaaccgctttaccactaggcatcgaaagcctacctatgagaaagacgtggatctcggcgctggcacacggtctgtgagtacggaaaccgagaagccagacatgactatcatagggagaaggctgcagcgcttgcaggaggaacacaaggagacatggcattacgatcaagaaaatccctaccgtacctgggcctatcacggatcctacgaggccccgagcactggttcagcgtcctctatggtcaacggcgttgtgaaactgctcacaaagccttgggacgtaattccaatggtgacccagcttgctatgacagatactacccccttcgggcagcagcgggtctttaaagaaaaggtggacacgagaacccctcaaccaaaacccggaacaaggatggttatgactaccacagcaaattggctgtgggccttactgggcaagaagaaaaacccgcgcttgtgcactcgagaggagttcatcagcaaggtgcggagtaatgctgccatcggtgcagtctttcaggaagagcaggggtggacctccgccaacgaagctgtgaacgacagcagattctgggagctcgtagataaagaaagggcgctgcaccaagagggaaagtgtgagtcttgcgtttataatatgatgggcaaacgcgaaaagaagctaggcgagtttgggagagccaaaggatcacgggcaatttggtacatgtggcttggtgctaggttcctggaattcgaggccctcggctttctgaacgaagaccattggttcgggcgtgagaatagttggtccggagtggagggcgaaggtttgcaccgactggggtatatactcgaggaaatcgataagaaagacggagatcttatgtacgcagacgatacggccggctgggacacacgcattaccgaggatgacctgcagaacgaggaattaatcactgagcagatggctcctcatcacaagattctggccaaagcgatctttaagttgacatatcagaataaggtcgtgaaagtgctcagacccaccccacggggcgcagtcatggatataatcagcaggaaggaccaacgcgggtctggacaggttggtacttacggcctgaacaccttcacaaatatggaagtgcagctaattagacagatggaggccgaaggggtaatcacgcaagatgacatgcagaaccctaaaggacttaaggagcgggtggagaaatggctgagggaatgcggcgtcgaccgactcaagcgtatggctatttcgggtgatgactgtgtggttaaacccctggatgagagatttgggacctcattgttattcctgaatgacatgggaaaggtgcgcaaggatatcccacagtgggaacccagcaaaggctggaagaactggcaggaggtccctttttgctcccatcacttccacaaaatatttatgaaggacggccggagtctcgtggtaccatgtaggaatcaagatgaacttattgggagagcccgcatctctcagggagcaggttggagcctgcgggagactgcttgcctaggcaaagcctacgctcagatgtggtccctgatgtatttccataggcgagacctcagattggcctcaatggcaatctgtagtgcggttccgacagagtggtttcccacctctcggactacatggagcattcacgcccatcaccagtggatgaccacggaagatatgctgaaggtgtggaacagggtctggatagaggacaatcctaacatgatcgataagacaccagtgcactcctgggaagacattccctaccttgggaaacgcgaggacctgtggtgcggatcactcatcggcttaagctctcgtgctacctgggccaagaatattcatactgcaatcacccaagttagaaacctgataggtaaagaagagtatgtggattacatgcctgtcatgaagcgatattccgctccaagtgagagcgaaggggtgttgtga

SEQ ID NO: 15690 - RNA, 9867 nt, synthetic construct
  misc_feature 1..9867: note = derived and/or modified CDS sequence (opt3) from DENV-4__JN983813__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatgctgggcgataccatgtccggcagaatcgggggacagacacatctagctataatggccgttttcaagatgtctccgggttacgtgctgggcgtctttctcaggaaactgaccagccgtgagactgcacttatggtgatcgggatggctatgacaaccacattgtcaattcctcacgacctgatggagttaatcgacggaattagtctcggcctgatccttctgaagatagtaactcagttcgataacacccaagtgggtacgctagccctctccctgacatttattcgctctaccatgagcttggtcatggcatggcggactatcatggccgttctgttcgtggtgaccttaatcccactctgtagaacatcctgcctgcagaaacagtcacattgggtcgaaattactgctcttatcctgggggcgcaagccttgcccgtgtatctcatgaccctgatgaagggagcaagcaggcgaagttggcctctaaatgagggcattatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatataacgggaagttcccctatcattgaagtgaagcaggacgaggatggcagcttttctatccgggacgtcgaggaaacaaacatgattaccttgctcgtgaaactggccctaatcactgtaagcggtctgtacccccttgctataccaatcacaatgaccctctggtatatgtggcaggtcaagactcaacgctccggggcactgtgggatgtgccgtcacctgccgcgacacagaaagctgccttgagtgagggagtttacagaattatgcagaggggcttattcggcaagacccaggtgggggtcggaatccacatggaaggtgtgttccacacgatgtggcatgttactcggggcagcgtgatttgtcacgagaccgggcgactggaaccctcttgggcagacgtcagaaatgatatgatctcctatggaggcggttggcgcctcggggacaaatgggataaggaggaggacgtgcaagtactggccatagaaccaggaaagaaccccaaacatgtgcagacaaagcctggcctttttaaaaccctgacaggcgagattggggctgttactttggacttcaagccaggaacctcaggtagtcccatcatcaataggaaaggcaaggtcattgggctatacggaaacggcgtggtgacgaaaagcggtgattatatatccgccatcacacaggcagaacgtattggggagcctgactacgaggtcgatgaagacatctttcggaagaagagactgactattatggatctccacccgggagctggcaaaaccaagaggatcctgccatctatagtacgcgaggcccttaaacgaagattacggacactgatcctcgcgcccaccagggtggttgccgcagaaatggaggaagctttgcgcggcctgcctattcgttatcagactccagccgtgaagtcggagcataccgggagagagatcgtcgacctcatgtgccacgctacattcacgactcggctgcttagctcaaccagggtgcccaattacaacctgattgttatggatgaagcacactttacagacccttccagtgtggccgcccgcggatacatctctacccgagtcgagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtgtggtttgtaccttctatcaaggccggcaatgacatagcaaactgcttgaggaagagcggtaaaaaggtgattcagctaagtcgcaaaaccttcgataccgaataccccaagactaaactgacagactgggattttgttgtcaccacagacatctccgagatgggggccaacttcagagctggcagggtgattgatccacggcgttgtctcaagccggtgatcttaactgacggacctgaacgcgtcatactggcgggccccattccagttacgcccgccagcgcagctcaacgaagagggaggatcggacggaatcctgcccaggaggatgaccagtatgtgttctctggtgatccacttaagaacgacgaagatcatgcacactggaccgaggccaaaatgctgctcgacaatatctacacacccgagggcattatccctactttgtttgggccggaacgcgagaagacccaggctattgatggagaattcagactgaggggcgagcaacggaaaacatttgtagagctcatgcgaagaggtgacctgccagtgtggctttcatataaggtcgcctccgcggggataagttacaaagaccgcgaatggtgcttcaccggcgagaggaacaatcagatcctagaagagaacatggaagtggagatttggactcgggagggagaaaagaagaaactgcgtcccaagtggttggatgcaagagtttatgccgaccctatggctttaaaagattttaaggagttcgccagcggcaggaaatcgatcacgctggacatcctcaccgaaattgcttctctgcccacatacctttccagccgcgcaaagctggccctcgataatatagtgatgttgcatactaccgagcgggggggacgagcttaccagcacgccctgaacgaactaccagagtcactggagacactcatgcttgtcgcactgttaggtgcgatgaccgccggcatctttttgttctttatgcaggggaagggaattggcaaactgagtatgggtctcatcactattgctgtagcctctgggctgctttgggtggcagaaatccaacctcagtggatagctgcctccatcattctggagttctttctcatggttttgctgatccccgaaccagagaagcagagaacacctcaggacaatcaattaatttatgtgatcctaacgatactgaccattatcggcctcattgcagccaacgaaatgggacttatcgagaaaactaagacagatttcggcttttaccaggtcaaaaccgagaccacaatactggacgtggatttgaggccggctagcgcgtggactctgtatgccgtcgcaacgaccatcctcacacccatgctgcgccacactattgaaaatacctcagctaaccttagtctcgccgccatcgcaaatcaggctgccgtgctgatggggttgggaaagggctggccactgcatcggatggacttaggtgttcctctactggcgatggggtgttacagccaggtgaaccccacaaccctcactgcttcccttgtaatgctgttggtgcactatgccattatcggaccaggcctgcaagcaaaagccacgagagaggctcagaagcgtacagcagccggtataatgaagaatcctaccgtcgatggcattactgttatcgacctcgaacccatctcttacgatccgaaattcgagaagcagctggggcaagtgatgcttttagtcctgtgcgcgggacagctcttgctgatgaggaccacatgggctttctgtgaggtgctaactctggccaccggcccaattctcacactttgggaagggaaccctggacggttttggaacacgaccatcgcagtaagcactgccaatatattccgcggctcctatctggctggtgccgggttggcattttcactgattaaaaacgctcagacaccccgaagaggaaccggcactgccggtgagacactcggcgaaaagtggaaaaggcagctgaattctttagaccggaaggagttcgaagagtacaagcgcagtgggatccttgaggtggacagaaccgaagcgaaatcggccctgaaggatggaagcaaaattaagcatgcagtttccaggggctcttcaaaaatccgatggatagtggagcgggggatggtcaagccaaagggaaaagtggtcgacctcggctgcggtcgtgggggatggagctactatatggctacgctaaagaacgtgaccgaagttaaaggctacacaaagggcgggcccggacacgaggaacctatcccgatggccacttatggttggaatctggtaaaattgcattccggcgtggatgtcttttacaagcccaccgagcaagtggacacactgctctgtgatattggggagagttctagcaacccaactatcgaagagggaagaacccttcgcgttctgaagatggtggaaccttggttgtcatccaaacccgagttctgcattaaggtcctgaatccttatatgccaacagtgatcgaagagctcgagaaattacagaggaagcacggcggtaacctggtacggtgtccccttagtagaaatagcacccacgaaatgtactgggtgtctggggcatccggaaacattgtttcaagcgtcaatactacgtcgaaaatgctgctaaaccgctttacaaccaggcatcgaaagcctacttatgagaaagacgtggatctcggcgctggcacccggtctgtgagtacagaaacggagaagccagacatgaccatcatagggagaaggctgcagcgcttgcaggaggaacacaaggagacttggcattacgatcaagaaaatccctaccgtacatgggcctatcacggatcctacgaggccccgagcaccggttcagcgtcctctatggtcaacggcgttgtgaaactgctcactaagccttgggacgtaattccaatggtgacacagcttgctatgaccgatacaactcccttcgggcagcagcgggtctttaaagaaaaggtggacaccagaacgcctcaaccaaaacccggaaccaggatggttatgacaactaccgcaaattggctgtgggccttactgggcaagaagaaaaacccgcgcttgtgcacacgagaggagttcatcagcaaggtgcggagtaatgctgccatcggtgcagtctttcaggaagagcaggggtggacttccgccagcgaagctgtgaacgactctagattctgggagctcgtagataaagaaagggcgctgcaccaagagggaaagtgtgagtcatgcgtttataacatgatgggcaaacgcgaaaagaagctaggcgagtttgggagagccaaaggaagtcgggcaatttggtacatgtggcttggtgctaggttcctggaattcgaggccctcggctttctgaatgaagaccattggttcgggcgtgagaactcctggagcggagtggagggcgaaggtttgcaccgactggggtatatactcgaggaaatcgataagaaagacggagatcttatgtacgcagacgataccgccggctgggacacgcgcattacagaggatgacctgcagaatgaggaattaatcaccgagcagatggctcctcatcacaagattctggccaaagcgatctttaagttgacttatcagaacaaggtcgtgaaagtgctcagacccacaccacggggcgcagtcatggatataatctctaggaaggaccaacgcgggtcgggacaggttggtacctacggcctgaatactttcaccaacatggaagtgcagctaattagacagatggaggccgaaggggtaatcacacaagatgacatgcagaatcctaaaggacttaaggagcgggtggagaaatggctgagggaatgcggcgtcgaccgactcaagcgtatggctatttcaggtgatgactgtgtggttaaacccctggatgagagatttgggacgagcttgttattcctgaacgacatgggaaaggtgcgcaaggatatcccacagtgggaaccctccaaaggctggaagaattggcaggaggtccctttttgcagtcatcacttccacaaaatatttatgaaggacggccggtctctcgtggtaccatgtaggaaccaagatgaacttattgggagagcccgcatcagccagggagcaggttggtccctgcgggagaccgcttgcctaggcaaagcctacgctcagatgtggtcactgatgtatttccataggcgagacctcagattggccagtatggcaatctgttctgcggttccgactgagtggtttcccacaagccggaccacttggtccattcacgcccatcaccagtggatgacaaccgaagatatgctgaaggtgtggaatagggtctggatagaggacaaccctaatatgatcgataagacgccagtgcactcatgggaagacattccctaccttgggaaacgcgaggacctgtggtgcggaagcctcatcggcttatcttcccgtgctacatgggccaagaacattcataccgcaatcactcaagttagaaatctgataggtaaagaagagtatgtggattacatgcctgtcatgaagcgatatagtgctccaagcgagtcggaaggggtgttgtga

SEQ ID NO: 15691 - RNA, 9867 nt, synthetic construct
  misc_feature 1..9867: note = derived and/or modified CDS sequence (opt3) from DENV-4__KF041260__SS-prME
  source 1..9867: mol_type = other RNA
agcaccatcacactgctctgccttattcccactgtgatggccttccacctgtccacgagagacggagagcctttgatgatagtcgctaagcatgaaagggggcggccattactgtttaaaaccaccgagggaatcaacaagtgtactctgattgccatggatctcggtgaaatgtgcgaggacaccgttacatacaaatgtccgctgcttgtgaataccgaacccgaggatatcgactgctggtgtaacctgacttctgcctgggtaatgtatggaacatgcacccagtcaggggagcgccgacgtgaaaagagaagtgtggcgttgacgcctcacagcggaatgggcctcgagactagggctgaaacctggatgtcctctgagggtgcctggaaacatgcacagcgggtcgagtcgtggattctgcgcaatccagggttcgccctgctcgctggatttatggcatacatgatcggccagacaggcatacagagaactgtgttctttatcttaatgatgctggttgccccctcatatgggatgaggtgtgtgggagtcggtaaccgggatttcgtggaaggcgtaagcgggggagcttgggttgaccttgtgttggagcacggcggttgcgtcaccacaatggcccaggggaagcctaccctggattttgaactaattaagacgactgcgaaagaggtggcactcctgcgcacatactgtatcgaagccagtatttccaatatcaccactgctacacgatgcccaacccaaggagagccctatcttaaggaggaacaggaccagcagtacatatgtagaagggatgtggtcgaccggggctggggcaacgggtgcggactgttcggtaaaggcggggttgtgacgtgcgccaagttttcttgtagcggaaaaattaccggcaatttgatccaaattgagaacctcgaatatacagtagtggtcactgtgcataatggtgatacccacgcagttgggaacgacacatccaatcacggcgtgactgctaccgtcacacctcgttcaccaagtgtggaggtagaactgccggattacggagagttaaccctggactgcgagccccgcagcggcatcgacttcaacgaaatgatcctcatgaagatgaataagaaaacttggcttgttcataagcagtggtttctggatttgcctctaccatggacggccggggcggacacatctgaggtgcactggaaccataaagaaagaatggtcaccttcaaggtgccccacgccaaaaggcaggatgtcactgtgctgggatcccaggagggtgcaatgcactcagctctcaccggcgccacagaagttgacagcggggatggaaatcatatgtttgctggccacctgaagtgtaaagtgcggatggagaaacttcgaattaagggtatgagttacaccatgtgctctgggaaattctccatagacaaggagatggccgaaactcaacatggcacaacggtagtcaaagtgaagtatgagggagcaggcgccccttgtaaagttccaatcgaaattcgcgatgtgaacaaggagaaggtcgtggggagaatcataagctcgacccccttcgctgagaacactaattctgtaacaaacattgaactggagccgccttttggagactcctacatcgtgatcggtgttggcgattcagcgttgaccctccactggttcaggaaagggagtagcattggaaagatgtttgaatccacatatcggggcgcaaaacgcatggccatcctgggtgagactgcttgggacttcgggtctgtcggcggattactgaccagcctaggcaaggccgtgcatcaggtgtttgggtcagtctacacgaccatgttcggaggcgttagttggatggtgaggattctcataggttttctggtgctttggatcgggacaaattccaggaacactagcatggcaatgtcttgcattgccgtaggaggcatcaccttgttcctgggttttacagtccacgctgatatgggctgtgccgtgtcatggagtgggaaagaactcaagtgcggaagcggcatcttcattatagacaatgttcacacttggaccgagcagtataagtttcaacccgagtccccagcacgtctggcgtctgctatccttaacgcccataaagacggggtgtgtggcattcggtcgacgacacgactggaaaatgtcatgtggaagcagatcaccaacgagttgaattacgtgctctgggaaggcggtcacgatctgactgttgtggcaggggacgtaaaaggagtcttaagcaagggcaaaagagccctggctcctcccgtgaacgatctaaagtattcctggaagacatggggtaaagccaagattttcaccccagagactagaaattcaacctttctcatcgacggccccgatacaagtgaatgccctaacgagcgccgggcatggaatttcctggaggtggaagactacgggttcggaatgtttacgaccaacatatggatgaaattcagagagggctctagcgaagtctgtgatcataggcttatgtccgctgccatcaaggaccagaaagcggttcacgccgatatggggtactggattgagtcaagcaagaatcagacttggcaaatcgaaaaggcttctttgattgaggtgaagacatgcctgtggccaaagacccacacactctggtccaacggagtactggagagtcagatgttaatcccgaaagcatatgccggcccctttagccagcataactaccgccagggttatgctactcaaaccatggggccttggcacctgggaaaacttgaaatagacttcggcgagtgcccaggtacgacagtgaccattcaggaagattgtgaccatcgaggcccctctttgcggactaccacagcctccgggaaactcgtcactcagtggtgctgtcgttcatgcaccatgcctccactgagatttctaggagaggatggctgttggtacgggatggagatcaggcccctgagtgaaaaggaggaaaatatggtgaaaagccaggtttcggcaggacaaggcacatccgagacgttctctatgggtctcctgtgccttaccttgtttgtggaagagtgtctgcgccggagagtcactaggaagcacatgattttagtggttgtgacaaccctctgcgcgatcatactaggcgggcttacttggatggacctgttgcgagccctcatcatgctggggaacacaatgagctcacgcatgggcgggcagacccatctagctattatggccgtcttcaagatgagtccgggatatgtactgggtatctttctccggaaactgacgtccagagagactgcacttatggtgattggcatggctatgaccacagttttgtctatccctcacgacctgatggagttcatagatgggattagcttaggactcatcctgcttaagatggtgacccactttgacaatactcaggtcggcacactggccctatccctcaccttcatcaaatcaacaatgccactggtgatggcatggaggactattatggccgtattgtttgtggtcaccctgatccccttatgtcgtacgagctgcctccagaagcaaagtcattgggttgagattacagctctgatacttggtgcgcaggccctgcctgtgtacttgatgaccctcatgaaaggggcatctaagcgctcctggcccctgaacgaaggaatcatggctgtgggcctagtcagcctgcttggctcggccctcctgaagaatgatgtgccattggccgggcctatggttgctggaggtctgttactcgcagcctatgtaatgtcaggctctagtgcggacctgtcccttgagaaagctgccactgtgcagtgggatgaaatggcagacattaccgggagctctcccatcattgaggtcaagcaagatgaggacggcagcttctccatccgggatgtggaagagacaaacatgataactctgttggttaaactcgccctgatcaccgtgtcaggcctatacccactggctattccggtcacgatgacactttggtacatgtggcaagtgaagacccagagaagtggtgcactctgggacgtacctagccccgccgcgactcagaaagctacactgaccgaaggggtctataggatcatgcaacgaggattgttcggcaagactcaggtgggcgttgggattcacatggagggagtgtttcatacaatgtggcacgtcacccggggttctgtgatctgtcatgaatccggccgcttagagccatcatgggccgatgttaagaatgacatgataagttacgggggaggctggagactgggtgataaatgggacaaggaggaagacgtgcaggtcctcgcagtggagcccgggaaaaaccctaagcacgtacagacgaaaccaggactgttcaagactcttaccggcgaaattggcgccgtgacactggattttaaacccgggaccagcggatcccctatcatcaataggaagggtaaggttattggcttgtatgggaacggagtcgtgacaaaatctggcgactacgtgtcggctataactcaagccgagcggatcggtgagccggattatgaagtcgacgaggatattttccgaaagaaaagactaaccatcatggacctgcacccaggggcaggaaagacgaaacgcattctccccagcatcgtaagggaagctctgaagcgtcggcttagaacattaatactggcccctactagggtggttgcggccgagatggaagaggcactccgcggcttgccaatccgataccagacccccgctgtgaagacagagcataccggcagagaaattgtcgatctgatgtgccacgccacttttaccacacggctcctgtcatccacgagggtgcctaattataaccttatcgttatggacgaggctcatttcactgatccgagttctgtggcagcccgcgggtacattagcacccgtgtcgaaatgggagaggccgctgcgatctttatgacagcaacacccccaggtactacagaccctttcccccagtccaattcaccaatagaagatattgagagagagatccctgaacggtcttggaacaccggctttgactggatcacggactaccaggggaaaactgtgtggttcgtacccagcattaaggccggaaatgatatcgctaactgcctgaggaaaagtggcaagaaagtggttcaattgtcccgcaagacatttgacaccgagtatccaaagaccaaactaactgattgggacttcgtcgtgacaaccgatataagcgaaatgggtgccaacttccgagcagggagagtgattgacccgcggaggtgtctgaagcctgtcatcattacagatggccccgagcgcgttatcctcgccggaccaatacccgtgactcctgcttctgcggcccagagaaggggccggattgggcgtaatccagcacaggaagacgatcaatacgtattttcaggagaccccttacgcaacgatgaggaccacgctcactggacggaggccaaaatgctgcttgataatatccatacccctgaaggtatcattccgacactgttcggcccagagcgagaaaagactcaggcaatcgacggggagtttagactcaggggagagcagcggaaaaccttcgtggaattgatgcgcagaggcgacctgcccgtctggctctcctataaggtggccagtgctggtattagctacaaggatagggagtggtgctttacaggggaacggaacaatcagatactggaggaaaacatggaggttgagatctggacccgagaaggcgagaaaaagaaacttagacctaagtggctagacgcccgcgtgtatgcggatcccgtcgcactgaaagacttcaaggaatttgcctcgggaaggaagtctattactttggatatcttaacggagatcgcttccctgccaacctacctcagctcacgggccaaactggctcttgacaatattgtaatgctgcacacaactgaacgtggcgggaaggcatatcaacatgccctcaacgagttgcctgagagtctggaaaccctaatgctggtggctctccttggagccatgacagcaggtatattcctgtttttcatgcagggcaaagggatgggaaagttatctatgggcttgatcgcgattgccgttgcttccggtctgctctgggtggccgagatccagccccagtggattgcagctagcatcatactggaatttttccttatggccctgctcatcccagagcctgaaaaacaaagaaccccgcaggataatcagttgatttacgtcatcctgactattttaacaatcatagggctagtggcagccaacgagatgggcctgattgagaagacgaaaaccgactttggattctaccaggtcaagactgaaacaaccatcctcgatgtggaccttaggcccgcttcagcgtggaccctgtatgccgttgcaacaactattttgacgccaatgctgcgccacaccatcgagaatacaagtgctaacctcagcctggccgccatagcaaatcaagctgccgtgcttatgggcctcgggaagggatggcctctgcatcggatggatttgggcgtacccctgttagcgatgggttgttactcccaggtgaacccaactaccctaacagcttctctggtcatgctccttgttcactatgccatcattgggcctggactgcaggcaaaagccacccgagaagctcagaagagaactgcagccggcatcatgaaaaatcccacggtggacggtattacagtcatcgatttggagccgataagctacgacccaaagttcgagaaacaactgggccaggtgatgctcctggtactttgcgcggggcagttactgctcatgaggaccacttgggctttttgtgaagtgttgaccctggccacaggacctattctaactctgtgggagggcaaccccgggcgcttctggaacaccacaatcgcagtttccacggccaatatctttcggggatcatatctcgctggcgccggtcttgcattctctctgattaagaacacccaaactccaagacgtgggacaggaaccactggcgaaacattgggtgagaagtggaaaaggcagctgaatagtctcgaccggaaggaatttgaggagtacaaacgctcgggcatcctggaagtggatcgaaccgaggctaagagcgccttaaaagacgggtccaagataaagtatgcggtctctagaggaacgtcaaaaattaggtggatcgtggaacggggcatggtcaagcccaaagggaaggtggttgatcttggatgcggccgcggtgggtggagctactacatggccaccctgaaaaacgtaacagaggtgaagggatatactaagggcggccctgggcacgaagaaccgattcccatggcaacctacggatggaatctcgtcaaactacattccggtgtggacgttttctataagccaacagaacaggtggatactctgttgtgtgacatcggcgaaagttctagcaaccctaccatagaggaagggagaacactgagggtcctcaaaatggtggagccctggctttcatccaagcctgaattttgcatcaaagtactgaatccatacatgcccaccgtgattgaggagttggaaaagctgcagcgaaaacacggaggcagtctcgttcggtgtcctttaagccgtaactctactcatgagatgtattgggtctccggtgtgtcagggaatatcgtgagctcggtcaacacgacatctaagatgctgcttaatagattcaccactcgctacaggaagccaacctatgaaaaagatgctgacctgggagccggcacacggagtgtttccacggagaccgagaagcccgatatggcaattatcggcagacgcctacaaaggctccaggaggaacacaaagaaacttggcactacgaccaggagaacccgtaccgaacatgggcttatcatgggagctacgaagccccttcaaccggatccgcctctagcatggtgaatggtgtagtgaagctgttgactaaaccatgggatgtcattcccatggtgacacagctggcgatgaccgacacaactccttttggccaacagcgggttttcaaggagaaggtggacaccagaacgccacagcccaaaccggggaccaggatgatcatgacaactaccgctaactggctctgggcacttctgggaaagaaaaagaatcctcgcttatgcacacgtgaggaatttataagtaaagtccggtccaacgccgctattggcgccgtgttccaggaggaacaaggttggactagcgcatctgaggccgtaaatgattcaagattttgggaactggttgacaaggagagggctttgcaccaggaggggaagtgtgaaagttgcgtgtataacatgatgggaaaacgcgagaagaaactcggcgagttcggccgagcgaaggggtcccgggccatctggtacatgtggctgggagcaagattcctagagtttgaagctcttggtttcctgaacgaggatcattggtttggcagggagaatagctggtctggggtcgaaggagagggcctccaccgcctgggttatatcttggaagacattgataaaaaggacggggatctgatatacgccgacgataccgcaggatgggacacgagaatcacagaggatgacctccttaacgaggaactgattaccgagcagatggcaccccatcacaagatcttagctaaagccattttcaagctgacttatcaaaataaagtggtgaaggtcttgcggccaacacctaaaggcgcggttatggatatcatatcgaggaaggaccagcgtggctcaggacaggtgggaacctacggtctcaacacttttaccaatatggaagtacagctgatccgacaaatggaggcagaaggcgtgattacacgcgacgatatgcacaaccccaaagggctaaaggagagagtcgagaagtggcttaaagaatgcggagtggaccggctgaagaggatggccatcagcggcgatgactgtgttgtgaaaccactcgatgagcgcttctccacgagtctgttgtttttaaatgacatgggtaaggtcagaaaagatattccccagtgggaaccttctaaggggtggaagaactggcaggaggtgccattctgcagccatcactttcataaaatcttcatgaaggacggacggtccctggtagttccgtgtaggaatcaggatgaactcataggccgagctcgtatttcacaaggcgccgggtggagtcttagagagaccgcatgcctgggaaaggcttacgcccagatgtggtctctaatgtattttcaccgccgggacctgaggctcgctagcatggccatctgttccgcagtgcccactgagtggttccctacatcaagaaccacttggagcatccacgcgcatcaccagtggatgacaaccgaagatatgttgaaggtctggaaccgcgtgtggattgaggacaatccaaacatgacggacaaaacacccgttcattcttgggaagatataccttacctgggtaagcgggaggacctttggtgcggctccctgatcgggctcagtagcagggccacctgggctaagaatattcacactgccatcacccaggtgcgaaacttaattggaaaagaagagtatgtcgattacatgccagtgatgaagagatattcggcaccctttgagtccgaaggcgtactgtga

SEQ ID NO: 15692 - RNA, 9867 nt, synthetic construct
  misc_feature 1..9867: note = derived and/or modified CDS sequence (opt3) from DENV-4__FJ024476__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgactgccacatgggtaatgtatggcacctgcacgcagtctggggagcgccgacgtgaaaagagatcagtggcgttgactcctcacagtggaatgggcctcgagaccagggctgaaacatggatgagctccgagggtgcctggaaacatgcacaacgggtcgagtcttggattctgcgcaatccagggttcgccctgctcgctggatttatggcatacatgatcggccagactggcatacagagaaccgtgttctttgttttaatgatgctggtggccccctcgtatgggatgaggtgtgtcggagtgggtaaccgggatttcgtagaaggcgtttcagggggagcttgggtggaccttgtcttggagcacggcggttgcgtgacaaccatggcccaggggaagcctacgctggattttgaactaactaagacaaccgcgaaagaggtggcactcctgcgcacttactgtatcgaagccagcattagtaatatcacaaccgctacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgccaagttttcctgttctggaaaaatcactggcaatttggtgcaaatagagaacctcgaatataccgtcgtggttacagtgcataatggtgatactcacgcagtcgggaacgacaccagcaatcacggcgtgacagctatgattacccctcgttccccatcagtagaggttaagctgccggattacggagaattaactctggactgcgagccccgcagtggcatcgacttcaacgagatgattctcatgaagatgaaaaagaaaacgtggcttgtgcataagcagtggtttctggatttgcctctaccatggacagccggggcggacaccagcgaagtccactggaattacaaagagagaatggtgactttcaaggtcccccatgccaaaaggcaggatgtgaccgttctgggatctcaggaaggtgcaatgcactccgctctcgccggcgctacagaggtggactcaggggatggaaaccacatgtttgccggccatctgaagtgtaaggtacggatggaaaaacttcgaatcaagggtatgagctataccatgtgcagtgggaaattctctatcgacaaggagatggcagagactcaacacggcacaacggtcgtgaaagttaagtacgaaggagccggcgctccttgtaaggtgccaattgagatacgcgatgtcaataaagaaaaggtggtagggagaatcatttccagcacccccctggcggagaacactaactcggtgacaaatatcgagttggaaccgcctttcggagactcttatatagttattggtgtcggcaactccgcactcaccctgcattggtttaggaaagggtcaagtatcggaaagatgttcgagagcacataccggggcgccaaacgcatggctatcttaggtgaaactgcctgggattttgggtccgtgggcggactgttcacctctctaggcaaggcagtgcaccaggtctttgggagcgtttatacgaccatgttcggaggcgtgtcatggatgattagaatcctcattggtctgcttgtgttgtggatagggacaaatagtaggaacacttccatggccatgacctgcatcgctgtaggaggcattacactgtttctcggtttcactgtccaggccgacatgggctgtgtggttagctggtctgggaaggagctgaaatgcggatcaggcatctttgtggtcgataatgtgcatacctggacggaacaatacaagttccagcccgagagtccagcacgtcttgcgagcgctatcctgaacgcccacaaagacggggtttgtggaattcggtccacaacccgattggagaatgtgatgtggaagcagataactaacgaactcaattatgtactgtgggagggcggtcacgacttaacagtcgtggcaggggatgtgaaaggagtcctgaccaagggcaagagagccctaactcctcccgtttctgacctcaaatactcgtggaagacctggggtaaagctaggatctttacaccagaagcccgcaacagcacgttcctgattgatggccccgacacctccgagtgccctaatgaacggagagcatggaactcacttgaggtggaggattacgggtttggaatgttcactacaaatatctggatgaagttcagggaaggcagttctgaggtatgtgaccatcgcttgatgagcgctgccattaaagatcagaaggcggtgcacgccgacatggggtattggatcgaatcctcaaaaaaccaaacctggcagatagagcgagctagcctgatcgaagtcaagacatgcctctggccaaagactcataccctgtggtctaatggagtgttagagtcccagatgctgattccgaaaagttacgcaggcccctttagccagcacaactatcggcaaggttacgccacgcagacaatggggccttggcaccttggaaagttggagatcggcttcggtgaatgcccaggcaccactgttaccattcaggaggattgtgaccatcgtgggccctctctcagaacaactaccgcttccggaaaactggtgacacagtggtgctgtaggtcatgcacgatgcctccactacgctttctgggcgaagatgggtgttggtatggaatggagatccggcccctcagtgagagagaagagaacatggtcaagagccaagtgaccgccggccagggtacttcggaaacattctccatggggctgctttgcttgaccctgtttgttgaggaatgtttaaggcgacgcgtgactcggaaacacatgatactcgtcgtagtgattacactgtgcgcaatcattcttggaggcctgacctggatggacttgctcagagcgctgatcatgctaggcgatacgatgtctgggaggataggaggtcagatccatctggccattatggctgttttcaagatgagcccgggctacgtgctcggggtctttctgcgtaagcttacttcacgcgagaccgccttgatggtgatcggaatggcaatgacaaccgtactgagtattcctcacgacttaatggagctcatcgacggcatatccctgggtcttattctgctaaaaatcgtgactcagttcgataatacacaagtcgggaccctcgctctgtctttgacatttatccggagcactatgccactggttatggcctggagaaccattatggcagtgttattcgtggtcacgctcatccccctgtgtaggacatcctgccttcagaagcagtcacattgggtggaaattaccgccctgatattgggagctcaagcgctccctgtttatctgatgactctaatgaaaggcgccagccgacggagttggcccctgaacgagggcatcatggcagtagggcttgtgtctctcctgggatccgctttgctgaagaatgacgtcccattagccggtcctatggtggccggcgggctcctgcttgctgcatacgttatgagcggatcgtcagccgatctgtctttggaaaaagcggctaacgtgcagtgggacgagatggccgatattaccggcagttcccccatcattgaagtcaagcaggacgaggatggtagcttttctatccgcgacgtggaggaaacaaatatgataactctcctggtaaagctagcactgatcaccgtcagcgggctttacccactcgccattccggtgacgatgacactgtggtatatgtggcaggttaaaacccaaagatccggagctttgtgggatgtgccttcacccgcagccactcagaaggcggctttaagtgagggcgtctacaggatcatgcagcggggcctgttcgggaaaacacaggtgggagttggtattcacatggaaggcgtgtttcacaccatgtggcatgtcactcgagggagcgtgatctgtcacgagacaggaagactcgaaccatcttgggccgacgtacgcaacgatatgatatcctatggcggtgggtggaggctgggagacaagtgggataaagaggaggacgtgcaagttcttgcaattgaacccggcaagaatcctaagcatgtccagaccaaaccaggcctgttcaagacgttgactggggagatcggagccgtgaccctagacttcaaacccggtacatcaggcagtcctatcattaaccgtaaggggaaagtgataggactgtacggcaatggtgtcgtaaccaagagcggggattatgtgtccgctatcacacaggccgaacggattggagagccggactacgaggttgatgaagacatctttagaaaaaagaggctcactattatggatctgcacccaggcgcaggcaagaccaaacgcatccttccctctatagtgcgagaggctttaaagagacggctgaggacgctcatcttggcccctacacgcgtcgtggcggccgaaatggaggaagcactgcgtgggctcccaattagatatcagactcccgctgttaaatcggagcataccggacgggagatcgtggacctgatgtgccacgccacattcaccactaggcttctgagctcaacccgcgtccctaactacaatttgattgtgatggatgaagctcactttacagacccgtccagtgtagcagcccgaggttacatctctacgagagtggagatgggcgaagccgctgcgatattcatgactgcaacccccccaggggccacagatccttttccccaaagcaactccccaattgaggacatcgaacgggagatccctgagaggtcatggaataccggattcgattggattactgactatcagggcaagacagtttggtttgtcccctctatcaaagctggtaacgacatagccaattgcctacgcaagagcgggaagaaagtggtgcagctgagtagaaagaccttcgatacggaatacccaaaaactaagctcacagactgggattttgtcgttaccaccgacatttccgagatgggcgcaaacttcagggccggacgggtgatcgatccgcgtcgctgtttaaaacctgtaattctgactgacggccccgaacgagtgatccttgctgggccaatacccgtcacacctgcgagcgccgcacaaagaaggggacggattggtcgcaacccagctcaggaggatgaccagtatgtgttttctggcgatcccctgaagaatgacgaagatcatgcccactggaccgaggcaaagatgctcttggacaacatctacacacctgaggggatcattccgactctgttcggaccagaaagagagaaaacgcaggccatcgatggcgaattcaggctccggggtgagcaacgaaagacctttgttgagctgatgagacgcggggaccttcccgtgtggctatcatataaagtcgcttccgccggcattagttacaaggacagggaatggtgcttcacaggagagcggaataaccagatactggaagagaatatggaagtagagatctggactcgtgagggcgaaaaaaagaagttgagacctaggtggttagatgcgcgcgtgtatgcagaccccatggccctgaaagattttaaggagttcgctagcgggcggaaatcgattaccctcgacatcctgacagaaatcgcctctcttccaacctacctgtccagccgagctaagctcgcattggataacattgttatgctgcatactacggagagaggaggtagggcctaccagcacgctctaaatgaactgcctgagtcactcgagacccttatgctggtggccttattgggcgcaatgacagcggggatatttctgttctttatgcagggaaaaggcatcggtaagctcagtatggggctgattactatcgccgtcgcttctggccttctgtgggtggccgaaattcaaccccagtggatcgcagcttccataatcctcgagttctttttgatggtcctgttaattccagaacctgagaagcagcgcaccccgcaggacaaccaactaatctatgtgattctgacaatcctcaccataattggacttatcgccgcaaatgaaatgggcctgattgagaaaactaagacagatttcgggttttaccaggttaaaacggagaccactatcttggacgtggatctgcggcccgccagcgcttggacactctatgcggtagccaccaccatactgacaccaatgcttagacacactatcgaaaacacgtcagcaaatctcagtctggctgccattgccaaccaggcagctgtgttgatgggactgggcaagggttggcctttacatcgtatggacctaggggtccccctgctcgccatgggatgttacagccaggttaatccaaccacacttactgcgtccctggtgatgttgctggtccactatgctatcattggccctggtctccaagccaaagcaaccagggaggcccagaagcggacagctgcaggcatcatgaaaaaccccaccgtggatgggataactgtaattgacctggaaccgatctcttacgatccaaagttcgagaagcagcttggacaagtgatgttactggttctctgcgccggccagttgctgctaatgcgcacgacatgggcgttttgtgaggtgctgaccctcgctactgggcctatccttaccctgtgggaaggaaatcccggccgattctggaacacaactattgccgtcagcaccgcaaacatcttcagaggttcctatttggccggggctggactggccttttcactcataaaaaatgcacagacaccaaggcggggcacgggtaccactggcgagacactgggggaaaagtggaaacgccagttaaactctcttgacagaaaggagttcgaagagtacaaaaggagtggaattctggaggtggaccgaaccgaagctaagtcggccctcaaggatggcagcaaaatcaagcatgcggtctcccgggggtcttcaaaaattcgttggatcgtggagagaggaatggttaagcccaaaggcaaggtagtggacctaggttgcgggcgcggaggctggagctactatatggccactctgaagaatgtcacagaagtgaaaggctacaccaaggggggacctggtcacgaggaaccgatacccatggcaacgtatggctggaacttggttaaactgcattccggggtggatgtcttttacaagccaaccgagcaagtggacacactcctttgtgatatcggagagagttctagcaatcctactattgaagagggcaggaccctgcgggtattgaaaatggtggaaccctggctgtcatccaagcctgagttctgcatcaaggttctcaacccatatatgcccacagtcattgaagagttagagaaactgcagagaaagcacggtgggaatcttgtgcgctgtcctctgagtaggaacagcactcacgaaatgtactgggtgtctggagcttccggcaatatcgtctcaagcgttaacaccacatcgaaaatgctactcaatcgatttaccactcggcatagaaagccaacgtatgagaaagacgtggatctgggcgccgggacaaggtctgtaagtaccgaaactgagaagcccgacatgaccattatcggacgccgtttgcagcggctgcaggaggaacacaaagagacatggcattacgatcaagaaaacccgtacagaacgtgggcatatcacggttcctacgaggctcctagcaccggctcagcctcctctatggtgaatggggtcgtgaagctccttactaagccatgggacgttatacccatggtgacacagctggccatgaccgatactacacctttcggacagcagagggtctttaaagaaaaggtggacacccgcacaccacaacccaaaccgggcactcgaatggtaatgaccacgaccgcgaactggttatgggctctgttgggtaagaaaaagaatcctcggctctgcacaagagaggagttcattagcaaggttaggagtaacgcagccatcggggctgtgtttcaggaagagcagggatggacttccgccagcgaagcagtcaatgactctcgcttctgggagctggtggataaagaaagagccctacaccaagagggcaagtgtgagtcatgcgtgtataacatgatgggcaaacgggaaaagaaacttggggagtttggaagggctaagggtagtcgtgcgatctggtacatgtggctgggcgcccgattcctcgaatttgaggcactggggttcttgaacgaagaccattggttcggacgcgagaattcctggagcggcgtcgagggtgaagggctgcacagactcggatatattcttgaggaaatagataagaaagacggcgatctgatgtacgctgacgataccgccggctgggacacacggatcactgaggatgacttacagaacgaggaactgattaccgagcagatggcaccccatcacaagatcttggccaaagctatttttaagctcacgtatcagaataaagttgtgaaggtactgaggccaacacctcgcggggccgtgatggatatcatatctagaaaggaccaacggggatcgggtcaggtcggcacctacgggctaaacactttcacaaatatggaagtgcagcttatcaggcagatggaggcggaaggagttattacccaagatgacatgcagaaccccaaaggcctgcgagagcgtgtggagaagtggctcaaagaatgcggtgtcgacagactgaagcgcatggcaatctcaggggatgactgtgtggtaaaaccattggatgagcggtttggaactagcttactgttcctcaatgacatgggcaaggttaggaaagatattccccagtgggaaccttccaagggctggaagaactggcaggaggtgccattttgcagtcatcacttccacaaaatctttatgaaggacgggagatctcttgtcgtgccgtgtcgcaatcaagatgaactgataggacgggccaggattagccagggtgctggctggtccctacgagagaccgcctgcctggggaaagcatacgctcagatgtggtcactcatgtatttccatagacgggacttgaggctggccagtatggctatctgttctgccgttcccacagagtggtttcctacgagccgcaccacttggtccatccacgcacatcaccagtggatgacaaccgaagatatgcttaaggtgtggaaccgtgtctggattgaggacaatccaaacatgactgataaaacacccgtgcactcatgggaagacataccttacctgggaaagagagaggacctctggtgcggcagcttaatcggtctgtcttcccgagcgacctgggccaagaatattcatacggctatcacacaagtaaggaacttgattgggaaagaagagtatgtggattacatgccagtcatgaagcggtatagtgcccccagcgagtcggaaggagttctgtga

SEQ ID NO: 15693 - RNA, 9867 nt, synthetic construct
  misc_feature 1..9867: note = derived and/or modified CDS sequence (opt3) from DENV-4__GQ868579__SS-prME
  source 1..9867: mol_type = other RNA
agcaccatcactctgctctgccttattcccactataatggccttccacctgtccacgagagacggcgagcctttgatgatcgtggctaagcatgaaagggggcggccattactgtttaaaaccacagagggaattaacaagtgtactctaatcgcaatggatctcggtgaaatgtgcgaggacaccgtcacatacaaatgtccgctgcttattaataccgaacccgaggatatcgactgctggtgtaacctgacttctacatgggttatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtagagtcgtggatactgcgcaatccagggttcgcactgctcgccggatttatggcttacatgatcggccagactggcattcagagaaccgtgttctttatcttaatgatgctggtcgcaccctcatatgggatgaggtgtgtgggagttggtaaccgggatttcgtggaaggcgtcagcgggggagcctgggtggaccttgtattggagcacggcggttgcgttacaaccatggctcaggggaagcctacgctggattttgaactaactaagacaaccgccaaagaggtggcgctcctgcgcacttactgtattgaagcacttatcagtaatataacaaccgccacgcgatgcccaacccaaggagagccctatctgaaggaggaacaggaccagcagtacatttgtagaagggatgtcgtggaccggggctggggcaacgggtgcggattgttcggtaaaggcggggtggtcacatgcgctaagttttcctgttctggaaaaatcactggcaatctcgttcaaattgagaacctggaatataccgtggtagtgacagtccataatggtgatactcacgccgtggggaacgacaccagcaatcacggcgttacagcaaccatcactcctcgttccccatcagtggaggtcaagttaccggattacggagaactgacgctcgactgcgagccccgcagtggcatcgacttcaacgagatgattcttatgaagatgaaaaagaaaacatggctggtgcataagcagtggtttttggatctacctctgccatggaccgctggggccgacactagcgaagtacactggaattacaaagagagaatggttaccttcaaggtgccccatgcgaaaaggcaggatgtcacagtgctcggatctcaggaaggtgccatgcactccgcactggctggcgccaccgaggtcgactcaggggatggaaaccacatgtttgctggccatcttaagtgtaaggtgcggatggaaaaactgcgaataaagggtatgagctatactatgtgcagtgggaaattctctatcgacaaggagatggccgagacacaacacggcacgaccgttgtgaaagtaaagtacgaaggagcaggcgccccttgtaaggtcccaattgagatccgcgatgtgaataaagaaaaggttgtggggagagtcatatccagcactcccttggctgagaacacaaactcggtgaccaatattgagctcgaaccgcctttcggagactcttatatcgtaatcggtgtgggcaactccgcgctgacattacattggtttaggaaagggtcaagtattggaaagatgttcgagagcacttaccggggcgcaaaacgcatggccatcctgggtgaaaccgcttgggattttgggtccgttggcggactattcacgtctctcggcaaggccgtccaccaggtgtttgggagcgtgtataccacaatgttcggaggcgtctcatggatgattagaatactgatcggttttcttgttttgtggattgggactaatagtaggaacacctccatggcaatgacatgcatcgccgtgggaggcatcactctgttcctcggttttaccgtgcgtgctgacatgggctgtgtagtcagctggtctgggcgggagctgaagtgcggatcaggcattttcgtggttgataatgtgcatacgtggacagaacagtacaaatttcaacccgagagtccagcccgacttgcaagcgcgatactgaacgctcacaaggacggggtctgtggaatcagatccaccactaggttggagaatgtgatgtggaaacagattacaaacgaactcaattatgttctgtgggagggcggtcacgacttaaccgtggtagccggggatgtcaagggagtgctgactaaaggcaagcgcgcactaacccctcccgtgtctgacctcaagtactcgtggaaaacatggggtaaggccaaaatcttcacgccagaagctcggaacagcacctttctgattgatggccccgacacttccgagtgccctaatgaaagaagggcctggaactcacttgaggtcgaggattacgggttcggaatgttcacaaccaatatctggatgaagtttcgcgaaggcagttctgaggtttgtgaccatcgattgatgagcgcagctataaaagatcagaaggccgtgcacgcggacatggggtattggatcgaatccagcaagaaccagacatggcaaattgagcgggccagcctgatcgaagtaaagacttgcctctggccaaagacccatacgctgtggtctaatggagtgttagagtcccagatgctgattccgaaaagttacgctggccccttcagccagcacaactatcgtcagggttacgcaacacaaaccgtcgggccttggcaccttggaaagttggagatcgattttggcgaatgcccaggtactaccgtgacaatacaggaggactgtgatcatagaggcccctctctcaggactaccacagcctccgggaaactggttacgcagtggtgctgtcgctcatgcaccatgcctccactacggttcctgggagaagacggctgttggtatgggatggagattagacccctcagtgagaaggaagagaacatggtgaaaagccaggtcactgctggacaatcgacatccgaaaccttttctatgggcctgctttgcttgactctgttcgtggaggaatgtttaaggcgacgcgttacacggaagcacatgatcctcgccgtggtcattaccctgtgcgcaatcatacttggtgggctgacgtggatggatttgctcagagcgctgatcatgctaggagacactatgagcggcaggattggcgggcagacccatctggccatcatggctgtatttaagatgtcaccgggatacgtgctcggtgttttcctgcgtaaacttacaagtcgcgagaccgccttgatggtgattggcatggcaatgactacaaccctgtccatccctcacgacttaatggagctcatagatgggatttctctgggacttatcctgctaaagatcgtcacacagtttgacaatactcaggtgggcaccctcgctctgagcttgacgttcattcggtccacaatgtcactggtaatggcctggagaaccatcatggcagtgttatttgtcgttactctcattccactgtgtaggaccagctgccttcaaaaacagagtcattgggtggaaataacagccctgatcttgggtgctcaggcgctccccgtgtatctgatgactctaatgaagggggcctctcgacggtcctggcctctgaacgagggaattatggcagtcggccttgtgagcctcctgggctcggctttgctgaaaaatgatgttcccttagccgggccaatggtagccggaggtctcctgcttgctgcatacgtgatgtcaggctctagtgccgacctgtccttggaaaaggcggctaacgtccaatgggatgagatggccgacatcaccgggagctctcctattatcgaagtgaagcaggatgaggacggatcattctccatacgcgatgttgaggaaacgaatatgatcacactcctggtgaaactagcactgattaccgtctcaggcctttaccccctcgccatcccagtgactatgacactgtggtatatgtggcaggtaaagacccagagaagtggtgctttgtgggacgtcccgagccctgcagccactcaaaaagcggctttatctgagggggtgtacaggattatgcagcggggactgtttggcaagacacaggttggcgtggggatccacatggaaggagtcttccacaccatgtggcatgtgacgcgaggttccgttatatgtcacgagactggcagactcgaaccctcatgggccgatgtgcgcaacgacatgattagttatgggggaggctggaggctgggtgataaatgggaccgtgaggaggacgtccaggtgcttgcaatcgaaccagggaagaatcccaagcatgtacaaaccaaacctggactgttcaagacattgaccggcgagatcggcgccgtgacactagattttaaaccagggactagcggatcccccattataaacaagaaaggtaaggttatcggcctgtacgggaatggagtcgtgaccaaatctggcgactatgtgtcggctattacgcaggccgaacggatcggtgagcctgattacgaggtcgacgaagatattttcagaaagaagaggctcacaatcatggacctgcacccgggggcaggaaaaactaagcgcatacttccaagcatcgtacgagaggctttaaaaagacggctgaggaccctcattttggcccccacacgcgtggttgcggccgaaatggaggaagcactgcgtggcctccctatcagatatcagaccccagctgtgaagtcagagcatactggccgggagattgtcgatctgatgtgccacgccacctttacaacgaggcttctgtccagtactcgcgtgcccaactacaatttgatcgttatggacgaagctcacttcaccgatccttctagcgtggcagcccgagggtacatatccacaagagtcgagatgggagaagccgctgcgatttttatgaccgcaactccgcccggtgccacagacccattccctcagtcaaactctcccatcgaggatatcgaacgggagattccagagaggagctggaataccggctttgactggatcacggactatcaagggaaaactgtgtggttcgtacctagtataaaggctggaaacgatattgccaattgcctacgcaagtccggcaaaaaggtgatccagctgagcagaaaaacatttgacaccgaataccccaagaccaaactcactgattgggacttcgttgtcacaaccgatatttctgagatgggtgcaaactttagggccgggcgggtgatcgacccacgtcgctgtttaaagccggtgatactgacagatggccctgaacgagtcattcttgctggacccatcccagttactcccgcgtcagccgcacagagaaggggccggatcgggcgcaaccctgctcaagaggacgatcagtatgtgttctccggagacccactgaagaatgatgaagaccatgcccactggacggaggcaaaaatgctcttggataacatttacacccccgagggtatcattcctacactgttcggcccggaaagagagaagactcaggccatagacggggaatttaggctccggggagagcagcgaaaaaccttcgtagagctgatgagacgcggcgaccttccagtgtggctaagttataaggtcgctagcgccggtatctcgtacaaagatagggaatggtgctttacaggggagcggaataaccaaattctggaagagaatatggaagtggagatctggacccgtgagggcgaaaagaagaaattgagacccaggtggttagacgcgcgcgtttatgcagatcctatggccctgaaggacttcaaagagtttgcttctggacggaagtccatcactctcgatattctgacggaaatagccagccttcccacctacctgtcaagtcgagctaaactcgcattggacaacatcgtgatgctgcatacaactgagagaggcgggagggcctaccagcacgctctaaatgaactgccagagtctctcgagacccttatgctggtcgccttattgggagcaatgacagcgggtaccttcctgtttttcatgcagggcaaggggattggaaagctctccatgggcctgatcactattgccatggctagcggtcttctgtggatcgccgaaatacagcctcaatggatcgcagcttcaattatcctcgagtttttcttgatggtactgttaattcccgaaccagagaaacagcgcacacctcaggataaccagctaatctatgtgatactgacgattctcgccatcattgggcttatcgcagccaatgaaatgggcctgatagagaagaccaaaactgactttggattctaccaagttaagacagagaccaccatcttggatgtggacctgcggccggctagtgcgtggacactctatgccgtcgcaactacgattctgacccccatgcttagacacacaatcgaaaacactagcgctaatctctccctggccgccattgcaaaccaggctgccgtgttgatgggcctggggaaaggatggccattacatcgtatggatctaggcgtccctctgctcgcgatgggttgttactctcaggtgaatcccaccacacttaccgctagcctggttatgttgctggtgcactatgccatcatagggccaggactccaggcaaaggccactagggaggctcaaaaacggacggcagccggcattatgaagaaccctacagtagacggtatcaccgtgatcgatctggaacccatttcctacgacccgaagtttgagaaacagcttggccaggtcatgttactggttctctgcgcggggcaattgctgctaatgcgcactacctgggctttctgtgaggtgctgacactcgccactggaccaatccttaccctgtgggaaggcaatcctgggcgattctggaacacaacgatagcagtctcaaccgccaacatttttagaggatcttatttggctggcgccggtctggcattcagtctcatcaagaatgctcaggcccccaggcgggggactggaacaaccggcgagactctgggtgaaaaatggaagcgccagttaaactcgcttgacagaaaagagtttgaagagtacaagaggagcggcattctggaggtggatcgaacagaagcgaagtccgccctcaaagacgggtctaagatcaaacatgcagtatcacggggaagctccaagatacgttggatcgtggagagaggcatggttaaaccaaaggggaaggtggtcgatctaggatgcggccgcggtgggtggagttactatatggctaccctgaaaaatgtgacggaagtcaagggatacaccaaaggcggccccgggcacgaggaacctattccgatggccacatatggatggaacttggtgaagctgcattctggtgttgacgtattctacaaacccactgaacaggtggataccctcctttgtgacatcggcgagagctcatccaatccaacaattgaagaggggaggactctgcgggtcttgaagatggtggaaccttggctgagtagcaagcccgagttttgcatcaaagttctcaacccttatatgccaaccgtgattgaagagttagagaagctgcaaagaaaacacggaggcaatcttgtccgctgtcccctgtctaggaactccacacacgaaatgtactgggtgtcaggtgcaagcgggaatatcgtatcgtctgtgaacaccacaagtaagatgctactcaatcgattcacgacacggcatagaaaacctacctatgagaaggatgttgacctgggagctggcactaggtccgtcagcaccgaaacagagaaaccagatatgacgataattggccgccgtttgcagcggctgcaggaggaacacaaggagacctggcattacgaccaggaaaacccctacagaacttgggcctatcacgggtcatacgaggccccgtccacaggatctgcgagcagtatggtgaatggtgtggtcaagctccttaccaaaccttgggatgttatcccaatggtgactcaactggctatgacagacaccacaccctttggccagcagagggtattcaaggaaaaagtggacactcgcacccctcagccaaagcccgggacgcgaatggtcatgaccacaactgcaaactggttatgggccctgttgggcaaaaagaagtccccgcggctctgcaccagagaggagtttatcagcaaagtgaggtctaatgctgccattggcgcagttttccaagaagaacagggttggacatcagccagtgaagctgtgaacgattcccgcttttgggagctggtcgacaaggaaagagcgctacaccaggaggggaaatgtgagagctgcgtgtataatatgatgggaaagcgggagaagaaacttggcgagttcggcagggccaaagggtctcgtgcaatatggtacatgtggctgggagctcgatttctcgagttcgaggccctgggtttcttgaacgaagatcattggtttggccgcgagaactcgtggtcaggggtagagggagaaggcctgcacagactcggttatatccttgaggaaattgacaaaaaggatggggacctgatgtacgcagatgacactgccggatgggatacccggatcacggaggacgatttacaaaatgaggaactgattacagagcagatggctcctcatcacaaaatcttggccaaggcgatattcaaactcacctatcagaacaaggttgtgaaggtcctgaggcccactccacgcggcgcagtgatggacatcattagcagaaaagatcagcggggctccgggcaagtgggaacatacggtctaaatacctttactaacatggaagtccagcttatcaggcagatggaggccgaaggcgttattacccaggacgacatgcaaaatcctaaggggctgaaagagcgagtggagaactggctccgtgaatgcggagtagatagactgaagcgcatggctatcagtggcgacgattgtgtggtcaaacccttggacgagcggttcggtacatctttactgtttctcaatgatatggggaaggtgaggaaagacataccacagtgggaacccagcaagggatggaagaactggcaggaggttcctttctgctcccatcactttcacaaaattttcatgaaggatggcagatcacttgtggtcccatgtcgcaatcaggacgaactgatcggccgggccaggatcagtcaaggggcaggatggtctctacgagagacggcttgcctgggtaaagcctacgctcagatgtggagcctcatgtattttcatagacgggatttgaggctggcctccatggcaatttgttcagcggtgccgaccgagtggttccccactagccgcacaacctggtctatacacgcccatcaccagtggatgactacagaagacatgcttaaggtatggaaccgtgtttggatcgaggataatcctaacatgattgacaaaaccccagtgcactcctgggaagacatcccctacctgggcaagagagaggatctctggtgcgggagtttaattggactgagctcgcgagctacgtgggccaagaatatccatacagcaataacccaggtcaggaacttgatcggcaaagaagagtatgtggactacatgcctgttatgaagcggtattccgctccatctgagtcagaaggtgtgctgtga

SEQ ID NO: 15694 - RNA, 9867 nt, synthetic construct
  misc_feature 1..9867: note = derived and/or modified CDS sequence (opt3) from DENV-4__GQ868580__SS-prME
  source 1..9867: mol_type = other RNA
agcaccatcacactgctctgccttattcccactataatggccttccacctgtccacgagagacggcgagcctttgatgatcgtggctaagcatgaaagggggcggccattactgtttaaaaccacagagggaattaacaagtgtactctaatcgcaatggatctcggtgaaatgtgcgaggacaccgtcacatacaaatgtccgctgcttattaataccgaacccgaggatatcgactgctggtgtaacctgacttctacatgggttatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtagagtcgtggatactgcgcaatccagggttcgcactgctcgccggatttatggcttacatgatcggccagactggcattcagagaaccgtgttctttgtcttaatgatgctggtggcaccctcatatgggatgaggtgtgttggagtgggtaaccgggatttcgtcgaaggcgtgagcgggggagcctgggtagaccttgttttggagcacggcggttgcgtgacaaccatggctcaggggaagcctacgctggattttgaactaactaagacaaccgccaaagaggtcgcgctcctgcgcacttactgtatcgaagcacttattagtaatatcacaaccgccacgcgatgcccaacccaaggagagccctatctgaaggaggaacaggaccagcagtacatatgtagaagggatgtggtggaccggggctggggcaacgggtgcggattgttcggtaaaggcggggtcgttacatgcgctaagttttcctgttctggaaaaattactggcaatctcgtgcaaatcgagaacctggaatataccgtagtggtcacagtgcataatggtgatactcacgccgttgggaacgacaccagcaatcacggcgtgacagcaaccattactcctcgttccccatcagtcgaggtgaagttaccggattacggagaactgacgctcgactgcgagccccgcagtggcatcgacttcaacgagatgatccttatgaagatgaaaaagaaaacatggctggtacataagcagtggtttttggatctacctctgccatggaccgctggggccgacactagcgaagttcactggaattacaaagagagaatggtgaccttcaaggtcccccatgcgaaaaggcaggatgtgacagtcctcggatctcaggaaggtgccatgcactccgcactggctggcgccaccgaggtggactcaggggatggaaaccacatgtttgctggccatcttaagtgtaaggttcggatggaaaaactgcgaattaagggtatgagctatactatgtgcagtgggaaattctctatagacaaggagatggccgagacacaacacggcacgaccgtggtaaaagtcaagtacgaaggagcaggcgccccttgtaaggtgccaatcgagattcgcgatgttaataaagaaaaggtggtcgggagaatcatatccagcactcccttggctgagaacacaaactcggtgaccaatattgagctcgaaccgcctttcggagactcttatatcgtaatcggtgtgggcaactccgcgctgacattacattggtttaggaaagggtcaagtattggaaagatgttcgagagcacttaccggggcgcaaaacgcatggccatcctgggtgaaaccgcttgggattttgggtccgttggcggactattcacgtctctcggcaaggccgtccaccaggtgtttgggagcgtgtataccacaatgttcggaggcgtctcatggatgattagaatactgatcggttttcttgttttgtggattgggactaatagtaggaacacctccatggcaatgacatgcatcgccgtgggaggcatcactctgttcctcggttttaccgtgcaggctgacatgggctgtgtagtcagctggtctgggcgtgagctgaagtgcggatcaggcattttcgtggttgataatgtgcatacgtggacagaacaatacaaatttcagcccgagagtccagcccggcttgcaagcgcgatactgaacgctcacaaggacggggtctgtggaatccgatccaccactagattggagaatgtgatgtggaaacagattacaaacgaactcaattatgttctgtgggagggcggtcacgacttaaccgtggtagccggggatgtcaagggagtgctgactaaaggcaagagggcactaacccctcccgtgtctgacctcaagtactcgtggaaaacatggggtaaggccaaaatcttcacgccagaagctcgcaacagcacctttctgattgatggccccgacacttccgagtgccctaatgaacggagagcctggaactcacttgaggtcgaggattacgggttcggaatgttcacaaccaatatctggatgaagtttagggaaggcagttctgaggtttgtgaccatcgcttgatgagcgcagctataaaagatcagaaggccgtgcacgcggacatggggtattggatcgaatcctcaaaaaaccaaacatggcagattgagcgagccagcctgatcgaagtaaagacttgcctctggccaaagacccatacgctgtggtctaatggagtgttagagtcccagatgctgattccgaaaagttacgctggccccttcagccagcacaactatcggcaaggttacgcaacacagaccgtcgggccttggcaccttggaaagttggagatcgattttggcgaatgcccaggtactaccgtgacaatacaggaggactgtgatcatcgtggcccctctctcagaactaccacagcctccgggaaactggttacgcagtggtgctgtaggtcatgcaccatgcctccactacgcttcctgggagaagacggctgttggtatgggatggagattcggcccctcaacgagaaggaagagaatatggtgaaaagtcaagtcactgctggacagagcacatcggaaaccttttccatgggcctgctttgcttgactctgttcgtggaggaatgtttaagaaggcgagttacacgcaagcacatgatcctcgccgtggtcattaccctgtgcgcaatcatacttggtgggctgacgtggatggatttgctccgggcgctgatcatgctaggagacactatgtctggcagaattggcgggcagacccatctggccatcatggctgtatttaagatgagcccgggatacgtgctcggtgttttcctgaggaaacttacatcacgtgagaccgccttgatggtgattggcatggcaatgactacaacctttagtatccctcacgacctgatggagttaatagatgggatttccctcggactgatccttctgaagatcgtcacacagttcgacaacactcaagtgggcaccctagctctctctctgacgtttattcgcagcacaatgtccttggtaatggcctggcggaccatcatggcagtgctgttcgtcgttactttaattccactctgtagaacctcatgcctgcagaaacagagccattgggtggaaataacagcccttatcctgggtgctcaagcgttgcccgtgtatctcatgactctgatgaagggggccagtaggcgatcttggcctctaaatgagggaattatggcagtcggcctggtgtcccttctcggcagcgctctgttgaaaaacgatgttcccctggccgggccaatggtagccggaggtttactcctggctgcatacgtgatgtcgggctcatctgccgaccttagtctggaaaaggcggctaatgtccagtgggatgagatggccgacatcaccgggtccagccctattatcgaagtgaagcaggatgaggacggatcttttagcatacgggatgttgaggaaacgaacatgatcacattgctcgtgaaactggcactaattaccgtctccggcctgtacccccttgccatcccagtgactatgacactctggtatatgtggcaggtaaagacccaacgctcaggtgctctgtgggacgtcccgagtcctgcagccactcagaaagcggctttgagcgagggggtgtacagaattatgcagaggggattactgggcaagacacaggttggcgtggggatccacatggaaggagtcttccacaccatgtggcatgtgacgcggggttctgttatatgtcacgagactggccgactcgaaccctcctgggccgatgtgagaaatgacatgatttcatatgggggaggctggcgcctgggtgataaatgggacagggaggaggacgtccaagtgcttgcaatcgaaccagggaagaaccccaagcatgtacagaccaaacctggactgttcaagacattgaccggcgagatcggcgccgtgacactagattttaaaccagggactagtggaagccccattataaatcgtaagggtaaagttatcggcctgtacgggaacggagtcgtgaccaagtccggcgactatgtgtctgctattacgcaggccgaacggatcggtgagcctgattacgaggtcgacgaagatattttcagaaaaaagaggctcacaatcatggacctgcacccgggggcaggaaagactaaacgcatacttccatcgatcgtacgagaggctttaaagagacggctgaggaccctcattttggcccccacacgcgtggttgcggccgaaatggaggaagcactgcgtggcctccctatcagatatcagaccccagctgtgaaaagcgagcatactggccgggagattgtcgatctgatgtgccacgccacctttacaacgaggcttctgtcatccactcgcgtgcccaattacaacttgatcgttatggacgaagctcacttcaccgatcctagttctgtggcagcccgagggtacataagcacaagagtcgagatgggagaagccgctgcgatttttatgaccgcaactccgcccggtgccacagacccattccctcaatccaattcacccatcgaggatatcgaacgggagattccagagaggtcttggaacaccggctttgactggatcacggactatcaggggaagactgtgtggttcgtacctagcataaaagctggaaatgatattgccaactgcctacgcaagagtggcaagaaagtgatccagctgtccagaaagacatttgacaccgaataccccaaaaccaagctcactgattgggacttcgttgtcacaaccgatattagcgagatgggtgcaaactttagggccgggcgggtgatcgacccacgtcgctgtttaaaaccggtgatactgacagatggccctgaacgagtcattcttgctggacccatcccagttactcccgcgtctgccgcacaaagaaggggccggatcgggcgcaatcctgctcaggaggacgatcagtatgtgttctcaggagacccactgaagaacgatgaagaccatgcccactggacggaggcaaagatgctcttggataatatttacacccccgagggtatcattcctacactgttcggcccggaaagagagaaaactcaggccatagacggggaatttaggctccggggagagcaacgaaagaccttcgtagagctgatgagacgcggcgaccttccagtgtggctatcctataaagtcgctagtgccggtatcagctacaaggatagggaatggtgctttacaggggagcggaacaatcagattctggaagagaacatggaagtggagatctggacccgtgagggcgaaaaaaagaagttgagacccaggtggttagacgcgcgcgtttatgcagatcctatggccctgaaagacttcaaggagtttgcttcgggacggaaatctatcactctcgatattctgacggaaatagcctcccttcccacctacctgagctcacgagctaagctcgcattggacaatatcgtgatgctgcatacaactgagagaggcgggagggcctaccagcacgctctaaacgaactgccagagagtctcgagacccttatgctggtcgccttattgggagcaatgacagcgggtattttcctgtttttcatgcagggcaaagggatcggaaagctctctatgggcctgattaccatcgccatggcttccggtcttctgtggatagccgaaatccaacctcagtggattgcagctagcatcattctcgagtttttcttgatggtactgttaatccccgaaccagagaagcagcgcactcctcaggataatcaactaatatatgtgattctgacaatcctcacgattatcgggcttatagccgcaaacgaaatgggcctgatcgagaaaaccaagactgactttggattctaccaggttaaaacagagaccaccattttggatgtggacctgcggccggcctcagcttggacactctatgcggtcgccactacgatcctgacccccatgcttagacacacaattgaaaatactagtgcaaacctcagcctggctgccatcgccaatcaggcagctgtgttgatgggcctggggaagggatggccattacatcgtatggatctaggcgtccctctgctcgccatgggttgttactcccaggtgaaccccaccacacttaccgcgtctctggttatgttgctggtgcactatgctataattgggccaggactccaagccaaagcaactagggaggcccagaagcggacggctgcaggcatcatgaaaaatcctacagtagacggtatcaccgtgattgatctggaacccatcagctacgacccgaagtttgagaagcagcttggccaagtcatgttactggttctctgcgccgggcagttgctgctaatgcgcactacctgggcgttctgtgaggtgctgacactcgctactggaccaatacttaccctgtgggaaggcaaccctgggcgattctggaacacaacgattgccgtctccaccgcaaatatctttagaggatcatatttggccggcgctggtctggccttctctctcattaaaaacgcacagactcccaggcgggggacaggaaccactggcgagacactgggtgaaaagtggaaacgccagttaaatagtcttgacagaaaggagtttgaagagtacaaaaggtcgggcatcctggaggtggatcgaaccgaagctaagagcgccctcaaggacgggtccaaaataaagcatgcggtatctcggggatcaagcaaaatccgttggattgtggagagaggcatggttaagccaaaagggaaggtggtcgatctaggatgcggccgcggtgggtggtcctactatatggccacgctgaagaacgtgaccgaagtcaaaggatacacaaagggcggccccgggcacgaggaacctatcccgatggcaacttatggatggaatttggtgaaactgcatagtggtgttgacgtattctacaagcccaccgagcaagtggatacactcctttgtgacattggcgagtctagctcaaacccaactatcgaagaggggaggaccctgcgggtcttgaaaatggtggaaccttggctgtccagtaagcccgagttttgcattaaggttctcaatccttatatgccaacagtgatcgaagagttagagaaactgcagagaaagcacggaggcaaccttgtccgctgtcccctgagcaggaattctacccacgaaatgtactgggtgtccggtgcttcagggaacatagtaagctcggtgaatactacgtctaaaatgctactcaaccgattcacaacccggcatagaaagcctacttatgagaaagatgttgacctgggagccggcaccaggagtgtctccacagaaacggagaagccagatatgaccattatcggccgccgtttgcagcggctgcaggaggaacacaaagagacttggcattacgaccaagaaaatccctacagaacatgggcatatcacgggagctacgaggctccgtcaaccggatccgcctctagcatggtgaacggtgtggtcaagctccttactaagccttgggatgttatcccaatggtgacacagctggccatgaccgacacaactccctttggccagcagagggtattcaaagaaaaggtggacacccgcacgcctcaaccaaaacccgggacccgaatggtcatgacaactaccgcgaattggttatgggctctgttgggaaagaaaaagagtccgcggctctgcacaagagaggagtttatttccaaggtgaggagcaacgcagccataggcgctgttttccaggaagagcagggttggacttctgcctcagaagcagtgagtgattcccgcttttgggagctggtcgacaaagaaagagccctacaccaagaggggaagtgtgagagctgcgtgtataatatgatgggaaaacgggaaaagaaacttggcgagttcggcagggctaaggggtctcgtgcgatctggtacatgtggctgggagcccgatttctcgaattcgaggcactgggtttcttgaacgaagatcattggtttggccgcgagaactcgtggtcaggggtagagggagaaggcctgcacagactcggttatattcttgaggaaatcgacaagaaagatggggacctgatgtacgctgatgacaccgccggatgggatacgcggattacagaggacgatttacagaatgaggaactgatcaccgagcagatggcacctcatcacaagatattggccaaagctatcttcaagctcacttatcagaacaaagttgtgaaggtcctgaggcccacaccacgcggcgccgtgatggacattatcagcagaaaggatcaacggggctccgggcaggtgggaacctacagtctaaatacttttaccaacatggaagtccagcttattaggcagatggaggcggaaggtgttatcacacaagacgacatgcagaatcctaaaggcctgaaggagcgagtggagaactggctccgtgaatgcggggtagatagactgaaacgcatggcaatatctggagacgattgtgtggtcaagcccttggacgagcggttcggcacgagcttactgtttctcaatgatatgggtaaagtgaggaaggacattccacagtgggaaccctccaaagggtggaagaactggcaggaggttcctttctgctcacatcactttcacaagatcttcatgaaagatggaagaagtcttgtggtcccatgtcgcaatcaagacgaactgatcggccgggccaggatttctcagggcgctgggtggagcctacgagagaccgcctgcctgggaaaggcatacgctcagatgtggtccctcatgtattttcatagacgggatttgaggctggcctcaatggctatatgtagcgccgtgccgactgagtggttccccacatctcgcaccacttggtccatccacgcacatcaccagtggatgacaaccgaagacatgcttaaagtatggaaccgtgtttggattgaggataatcctaacatgatcgacaagacgccagtgcacagttgggaagacattccctacctgggtaaaagagaggatctctggtgcggcagcttaatcgggctgtcgtcccgagcgacatgggccaagaatatacataccgctatcactcaagtcaggaacttgattggaaaggaagagtatgtggactacatgcctgttatgaaacggtattctgccccatcagagagcgaaggcgtgctgtga

SEQ ID NO: 15695 - RNA, 9867 nt, synthetic construct
  misc_feature 1..9867: note = derived and/or modified CDS sequence (opt3) from DENV-4__GQ868583__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcatgataggtgtcggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtgcaccaggtctttgggtctgtttatacaactatgttcggaggcgtgagctggatgatcagaattctgatcggttttcttgtgttgtggattgggaccaattcaaggaacacaagtatggcaatgacttgcatagccgtaggaggcatcaccctgttcctcggttttacggtccaggctgacatgggctgtgtggtttcctggagcgggcgtgagctgaagtgcggatctggcattttcgtggtcgataatgtgcatacatggaccgaacaatacaaatttcagcccgagtcaccagcccggcttgcaagtgcgatcctgaacgctcacaaggacggggtttgtggaatccgaagcactacaagattggagaatgtgatgtggaaacagattaccaacgaactcaattatgtactgtgggagggcggtcacgacttaactgtcgtggccggggatgtgaagggagtcctgaccaaaggcaagagggcactagcccctcccgcttccgacctcaagtactcttggaaaacatggggtaaggccaaaatattcacgccagaagcacgcaactcgacctttctgatcgatggccccgacactagcgagtgccctaatgaacggagagcttggaactccttcgaggttgaggattacgggttcggaatgtttacaaccaatatttggatgaagttcagggaaggctcaagtgaggtgtgtgaccatcgccttatgtctgccgcgatcaaagatcagaaggccgtacacgctgacatggggtattggattgaaagctccaaaaaccaaacatggcagatcgagcgagcatcattgatagaagtgaagacttgcctgtggccaaagacccatacgctctggagcaatggagtcctggagtctcagatgttaatcccgaaatcctacgccggcccctttagtcagcacaactatcggcaaggttacgctacacagaccgtggggccttggcacctgggaaagcttgagattgatttcggcgaatgcccaggtactaccgttacaatccaggaggactgtgatcatcgtggccccagcttgagaactaccacagcctctgggaaactcgtgacgcagtggtgctgtaggtcctgcaccatgcctccactgcgctttctaggagaagacggctgttggtatgggatggagattcggcccctgtcagagaaggaagagaacatggtcaaaagtcaagtgactgcaggacagggcacaagcgaaaccttctcgatgggtctcctgtgccttactttgtttgttgaggaatgtctgagaaggcgagtgacacgcaagcacatgatcttagcggtcgtaataaccctctgcgccattatcctggggggacttacgtggatggatctgttgcgggctctcattatgctgggcgacactatgtccggcagaatcgggggacagacccatctagccataatggcagtgttcaagatgtctccgggttacgttctgggcgtgtttctcaggaaactgacaagccgtgagaccgctcttatggtcatcgggatggccatgactacaaccttgtcaattcctcacgacctgatggagttaatcgatggaattagtctcggcctgatccttctgaagatagtgacacagttcgacaatactcaagtaggtaccctagcactctccctgacgtttattcgctctacaatgagcttggtgatggcctggcggaccatcatggctgtcctgttcgttgtgactttaatcccactctgtagaacctcctgcctgcagaaacagtcacattgggtggaaattacagcgcttatcctgggggcccaagcattgcccgtctatctcatgactctgatgaagggagctagcaggcgaagttggcctctaaacgagggcattatggccgtgggcctggtttctcttctcgggtccgccctgttgaaaaatgatgtacccctggctggaccaatggtggcaggtggcttactcctggccgcgtacgtcatgagcgggtcgtcagctgacctttctctggaaaaggccgcaaacgtgcagtgggatgagatggccgacataaccggaagttcccctatcattgaagttaagcaggatgaggacggcagcttttctatccgggatgtggaggaaacgaatatgattacattgctcgtcaaactggctctaatcaccgtgagcggtctgtacccccttgcaataccagtaactatgacactctggtatatgtggcaggtcaagacccaacgctccggggccctgtgggacgtgccgtcacctgcggctactcagaaagccgcattgagtgagggagtttacagaatcatgcagaggggcttattcggcaagacacaggtgggggtcggaattcacatggaaggtgtgttccacaccatgtggcatgttacgcggggcagcgtgatctgtcacgagactgggcgactggaaccctcttgggccgatgtcagaaacgacatgatttcctatggaggcggttggcgcctcggggataaatgggacaaggaggaggacgtgcaagtactggctatcgaaccaggaaagaatcccaaacatgtgcagaccaagcctggcctttttaaaacactgaccggcgagataggggccgttacattggatttcaagccaggaacttcaggtagtcccattatcaacaggaaaggcaaggtcatcgggctatacggaaatggcgtggtgaccaaaagcggtgactatgtctccgcaattacgcaggctgaacgtataggggagcctgattacgaggtagacgaagatatctttcggaagaagagactgacaattatggacctccacccgggagccggcaaaactaagaggatcctgccatctattgtgcgcgaggcgcttaaacgaagattacggaccctgatcctcgcccccacaagggttgtggcagctgaaatggaggaagccttgcgcggcctgcctatacgttatcagaccccagctgtcaagtcggagcatactgggagagagatcgtggatctcatgtgccacgcaaccttcacaacgcggctgcttagctcaactagggttcccaactacaatctgattgtgatggacgaagcccactttaccgatccttccagtgtcgccgctcgcggatacatctctacacgagtggagatgggtgaagcggcagccattttcatgaccgctactccgcccggcgccacagacccatttcctcaaagcaactcccccatcgaggatatagaaagagagattccagagcggtcatggaataccgggttcgactggatcacggactatcagggaaaaactgtatggtttgtgccttctatcaaggcaggcaacgatattgccaattgcttgaggaagagcggtaaaaaggttatccagctaagtcgcaaaacattcgacaccgaataccccaagaccaaactgactgattgggactttgtcgtgacaaccgatatatccgagatgggggctaacttcagagcgggcagggtgattgacccacggcgttgtctcaagccggtcatcttaacagatggacctgaacgcgttattctggccggccccatcccagtgactcccgcaagcgctgcccaacgaagagggaggataggacggaaccctgcacaggaggacgatcagtatgtattctctggtgacccacttaagaatgatgaagaccatgcccactggacggaggctaaaatgctgctcgataacatttacacccccgagggcatcatccctacattgtttgggccggaacgcgagaagactcaggccattgacggagaattcagactgaggggcgagcaacggaaaacctttgtggagctcatgcgaagaggtgacctgccagtctggctttcatataaggtggcgtccgcagggatcagttacaaagatcgcgaatggtgcttcacaggcgagaggaataaccagattctagaagagaatatggaagttgagatatggacccgggagggagaaaagaagaaactgcgtcccaagtggttggacgccagagtgtatgctgatcctatggccttacaggactttaaagagttcgctagcggcaggaagtcgatcactctggatattctcacggaaatcgcatctctgcccacctacctttccagccgcgccaaactggctctcgacaacatcgtcatgttgcatacaactgagcgggggggacgagcctaccagcacgcactgaatgaactaccagagtcactggagaccctcatgcttgtagcgctgttaggtgccatgacagctggcatttttttgttctttatgcaagggaagggaataggcaagctgagtatgggtctcatcaccattgccgtggcatctgggctgctttgggttgctgaaatccagcctcagtggattgccgcatccatcatactggagttctttctcatggtgttgctgatccccgaaccagagaaacagagaactcctcaagataaccagttaatttatgtcatcctaacaattctgacgatcataggcctcattgccgctaatgaaatgggacttatcgagaagaccaaaactgacttcggcttttaccaggtgaagacagagaccaccattctggatgtcgacttgaggccggcgagcgcctggacactgtatgcagtggctactacgatcctcacccccatgctgcgccacacaatagaaaacacttcagccaatcttagtctcgccgcaatcgctaaccaggccgcggttctgatggggttgggaaaaggctggccactgcatcggatggatttaggtgtgcctctactggctatggggtgttacagccaagtaaatcccaccacactcaccgcctcccttgtgatgctgttggtccactatgcaattatcggaccaggcctgcaggccaaggctactagagaggcacagaaacgtacggccgcgggtattatgaagaaccctacagttgacggcatcaccgtgatagatctcgaacccatttcttacgacccgaagttcgagaaacaactggggcaggtcatgcttttagtgctgtgcgctggacagctcttgctgatgaggactacctgggccttctgtgaggtactaacactggcaactggcccaatcctcaccctttgggaagggaatcctggacggttttggaacacaacgatcgccgtgagcaccgctaacattttccgcggctcctatctggccggtgcagggttggctttttcactgatcaagaatgcccagactccccgaagaggaacaggcaccactggtgagacactcggcgaaaaatggaagaggcaactgaactctttagaccggaaagagttcgaagagtacaagcgcagtgggatacttgaggttgatagaaccgaagcgaagtcggccctgaaagacggaagcaagattaaacatgcagtgtccaggggctcttcaaagatccgatggattgtcgagcgggggatggtgaaaccaaagggaaaggtcgtggatctcggctgcggtcgtgggggatggagctactatatggctacgctaaaaaatgttaccgaagtaaagggctacacaaaaggcgggcccggacacgaggaacctatcccgatggccacttatggttggaacctggtgaagttgcattccggcgtcgacgtgttttacaaacccaccgagcaggttgatacactgctctgtgacataggggagagttctagcaatccaactatcgaagagggaagaacccttcgcgtgctgaagatggtcgaaccttggttgtcatccaagcccgagttctgcattaaagtgctgaacccttatatgccaacagtaatcgaagagctcgagaagttacagaggaaacacggcggtaatctggtgcggtgtccccttagtagaaacagcacccacgaaatgtactgggtttctggggcatccggaaatattgtctcaagcgtgaacactacgtcgaagatgctgctaaatcgctttacaaccaggcatcgaaaacctacttatgagaaggatgtggacctcggcgctggcacccggtctgtcagtacagaaacggagaaaccagatatgaccatcattgggagaaggctgcagcgcttgcaagaggaacacaaggagacttggcattacgaccaggaaaacccctaccgtacatgggcctatcacggatcctacgaggccccgagcaccggttcagcgtcctctatggttaatggcgtggtaaagctgctcactaaaccttgggatgtgatcccaatggtcacacagcttgctatgaccgacacaactcccttcgggcagcaacgggtgtttaaggaaaaagttgacaccagaacgcctcagccaaagcccggaaccaggatggtgatgacaactaccgcaaactggctgtgggccttactgggcaaaaagaagaatccgcgcttgtgcacacgagaggagttcataagcaaagtccggagtaacgctgccattggtgcagtgtttcaggaagagcaagggtggacttccgccagcgaagctgtatctgattcaagattctgggagctcgttgacaaggaaagggcgctgcaccaggagggaaaatgtgagagttgcgtgtataatatgatgggcaagcgcgaaaaaaagctaggcgagtttgggagagccaagggatcccgggcaatctggtacatgtggcttggtgctaggttcctggaattcgaggccctcggctttctgaacgaagatcattggttcgggcgtgagaacagctggtctggagtcgagggcgaaggtttgcaccgactggggtatatcctcgaggaaattgacaaaaaggatggagaccttatgtacgcagatgacaccgccggctgggatacgcgcataacagaggacgatctgcagaatgaggaattaatcaccgagcagatggctcctcatcacaaaattctggccaaggcgatctttaaattgacttatcaaaacaaggtggtgaaggtcctcagacccacaccacggggcgcagttatggacattatctcgaggaaagatcagcgcgggtcaggacaggtgggtacctacggcctgaatactttcaccaacatggaagtacagctaataagacaaatggaggccgaaggggtgatcacacaggacgacatgcagaatcctaagggacttaaagagcgggtcgagaagtggctgagggaatgcggcgtggatcgactcaaacgtatggctattagcggtgacgattgtgttgtgaagcccctggacgagagatttgggacgtccttgttattcctgaacgatatgggaaaagtccgcaaggacatcccacagtgggaacccagtaagggctggaaaaattggcaagaggtgcctttttgctctcatcacttccacaagatttttatgaaagatggccggagcctcgtagttccatgtaggaaccaggacgaacttatcgggagagcccgcatatcccagggagcaggttggtcactgcgggagaccgcttgcctaggcaaggcctacgctcagatgtggagtctgatgtatttccataggcgagatctcagattggcctctatggcaatttgtagcgcggtgccgactgagtggtttcccacatcccggaccacttggtcaatccacgcccatcaccaatggatgacaaccgaagacatgctgaaagtctggaatagggtgtggatcgaggataaccctaatatgattgacaagacgccagttcacagctgggaagacataccctaccttgggaagcgcgaggatctgtggtgcggatctctcatcggcttatccagtcgtgctacatgggccaaaaacattcataccgcaatcactcaggtgagaaatctgattggtaaggaagagtatgtcgactacatgcctgtgatgaaacgatatagcgctccatcggagtccgaaggggtattgtga

SEQ ID NO: 15696 - RNA, 9867 nt, synthetic construct
  misc_feature 1..9867: note = derived and/or modified CDS sequence (opt3) from DENV-4__GQ868584__SS-prME
  source 1..9867: mol_type = other RNA
tcaaccatcacactgctctgccttattcccactgtgatggccttccacctgtccacgagagacggcgagcctttgatgatagtcgctaagcatgaaagggggcggccattactgtttaagaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcattcagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggacagacagtacatttgtaggcgggatgtcgttgaccgtggctggggcaacgggtgcggattgttcggtaaaggcggggtggtaacatgcgctaagttttcctgttctggaaaaatcactggcaatctcgtgcagatagagaacctggaatataccgtcgtggttacagtgcataatggtgatactcacgccgtcgggaacgacaccagcaatcacggcgtgacagcaaccattactcctcgctccccatcagtagaggttaagttaccggattacggagaactgacgctcgactgcgagcccagaagtggcatcgacttcaacgagatgattcttatgaagatgaaaaagaaaacatggctggtgcataagcaatggtttttggatctacctctgccatggaccactggggctgacaccagcgaagtccactggaattacaaagagaggatggtgacattcaaggtcccccatgccaaacggcaggatgtgaccgttctcggatctcaggaaggtgcgatgcactccgccctggcaggcgctactgaggtggactcaggggatggaaaccacatgtttgccggccatcttaagtgtaaggtacgaatggaaaaactgcgcatcaagggtatgagctatacaatgtgcagtgggaaattctctatcgacaaggagatggctgagacgcagcacggcaccactgtcgtgaaagttaagtacgaaggagccggcgcaccttgtaaggtgccaattgagataagagatgtcaataaagaaaaggtggtagggagggtgatctccgccacacccttggctgagaacaccaacagcgttacaaatattgagctcgaaccgcctttcggagactcgtatatcatgataggtgtcggcaactctgcgctgactttacattggtttcggaaagggtcctcaattggaaagatgttcgagagtacctaccgcggcgcaaaaagaatggccatcctgggtgaaacggcttgggattttgggagcgtgggcggactattcacctccctcggcaaggccgtgcaccaagtctttgggtctgtttatacaactatgttcggaggcgtgagctggatgatcaggattctgatcggttttcttgtgttgtggattgggaccaattcacgtaacacaagtatggcaatgacttgcatagccgtaggaggcatcaccctgttcctcggttttacggtccaggctgacatgggctgtgtggtttcctggagcgggcgggagctgaagtgcggatctggcattttcgtggtcgataatgtgcatacatggaccgaacagtacaaatttcaacccgagtcaccagcccgacttgcaagtgcgatcctgaacgctcacaaggacggggtttgtggaatcagaagcactacaaggttggagaatgtgatgtggaaacagattaccaacgaactcaattatgtactgtgggagggcggtcacgacttaactgtcgtggccggggatgtgaagggagtcctgaccaaaggcaagcgcgcactagcccctcccgcttccgacctcaagtactcttggaaaacatggggtaaggccaaaatattcacgccagaagcacggaactcgacctttctgatcgatggccccgacactagcgagtgccctaatgaaagaagggcttggaactccttcgaggttgaggattacgggttcggaatgtttacaaccaatatttggatgaagttccgcgaaggctcaagtgaggtgtgtgaccatcgacttatgtctgccgcgatcaaagatcagaaggccgtacacgctgacatggggtattggattgaaagctccaaaaaccagacatggcaaatcgagcgggcatcattgatagaagtgaagacttgcctgtggccaaagacccatacgctctggagcaatggagtcctggagtctcagatgttaatcccgaaatcctacgccggcccctttagtcagcacaactatcgtcagggttacgctacacaaaccgtggggccttggcacctgggaaaacttgagattgatttcggcgaatgcccaggtactaccgttacaatccaggaggactgtgatcatagaggccccagcttgaggactaccacagcctctgggaaactcgtgacgcagtggtgctgtcgctcctgcaccatgcctccactgcggtttctaggagaagacggctgttggtatgggatggagattagacccctgtcagagaaggaagagaacatggtcaaaagtcaggtgactgcaggacaaggcacaagcgaaaccttctcgatgggtctcctgtgccttactttgtttgttgaggaatgtctgaggcgacgcgtgacacggaagcacatgatcttagcggtcgtaataaccctctgcgccattatcctagggggccttacgtggatggatctgttgagagctctcattatgctgggcgacactatgtccggcaggatcgggggacagacccatctagccataatggcagtgttcaagatgtctccgggttacgttctgggcgtgtttctccgtaaactgacaagccgcgagaccgctcttatggtcatcgggatggccatgactacaaccttgtcaattcctcacgacctgatggagttaatcgatggaattagtctcggcctgatccttctgaagatagtgacacagttcgacaatactcaggtaggtaccctagcactctccctgacgtttattcggtctacaatgagcttggtgatggcctggagaaccatcatggctgtcctgttcgttgtgactttaatcccactctgtaggacctcctgcctgcaaaaacagtcacattgggtggaaattacagcgcttatcctgggggcccaggcattgcccgtctatctcatgactctgatgaagggagctagccgacggagttggcctctaaacgagggcattatggccgtgggcctggtttctcttctcgggtccgccctgttgaaaaatgatgtacccctggctggaccaatggtggccggtggattactcctggcagcgtacgtcatgagcgggtcgtcagctgacctttctctggaaaaggccgcaaacgtgcaatgggatgagatggccgacataaccggaagttcccctatcattgaagttaagcaggatgaggacggcagcttttctatccgcgatgtggaggaaacgaatatgattacattgctcgtcaaactggctctaatcaccgtgagcggtctgtacccccttgcaataccagtaactatgacactctggtatatgtggcaggtcaagacccagagatccggggccctgtgggacgtgccgagccctgcggctactcaaaaagccgcattgagtgagggagtttacaggatcatgcagcggggcttattcggcaagacacaggtgggggtcggcattcacatggaaggtgtgttccacaccatgtggcatgttacgcgaggcagcgtgatctgtcacgagactgggagactggaaccctcttgggccgatgtccgcaacgacatgatttcctatggaggcggttggaggctcggggataaatgggacaaggaggaggacgtgcaggtactggctatcgaaccaggaaagaatcccaaacatgtgcaaaccaagcctggcctttttaaaacactgaccggcgagataggggccgttacattggatttcaagccaggaacttcaggtagtcccattatcaaccgtaaaggcaaggtcatcgggctatacggaaatggcgtggtgaccaaaagcggtgactatgtctccgcaattacgcaggctgaacggataggggagcctgattacgaggtagacgaagatatctttagaaagaagaggctgacaattatggacctccacccgggagccggcaaaactaagcgcatcctgccatctattgtgcgagaggcgcttaaaagacggttaaggaccctgatcctcgcccccacacgcgttgtggcagctgaaatggaggaagccttgcgtggcctgcctataagatatcagaccccagctgtcaagtcggagcatactgggcgggagatcgtggatctcatgtgccacgcaaccttcacaacgaggctgcttagctcaactcgcgttcccaactacaatctgattgtgatggacgaagcccactttaccgatccttccagtgtcgccgctcgaggatacatctctacaagagtggagatgggtgaagcggcagccattttcatgaccgctactccgcccggcgccacagacccatttcctcagagcaactcccccatcgaggatatagaacgggagattccagagaggtcatggaataccgggttcgactggatcacggactatcaaggaaaaactgtatggtttgtgccttctatcaaggcaggcaacgatattgccaattgcttgcgcaagagcggtaaaaaggttatccagctaagtagaaaaacattcgacaccgaataccccaagaccaaactgactgattgggactttgtcgtgacaaccgatatatccgagatgggggctaacttcagggcgggccgggtgattgacccacgtcgctgtctcaagccggtcatcttaacagatggacctgaacgagttattctggccggccccatcccagtgactcccgcaagcgctgcccagagaagggggcggataggacgcaaccctgcacaagaggacgatcagtatgtattctctggtgacccacttaagaatgatgaagaccatgcccactggacggaggctaaaatgctgctcgataacatttacacccccgagggcatcatccctacattgtttgggccggaaagagagaagactcaggccattgacggagagttcaggctgcggggcgagcagcgaaaaacctttgtggagctcatgagacgcggtgacctgccagtctggctttcatataaggtggcgtccgcagggatcagttacaaagatagggaatggtgcttcacaggcgagcggaataaccaaattctagaagagaatatggaagttgagatatggacccgtgagggagaaaagaagaaactgagacccaagtggttggacgccagggtgtatgctgatcctatggccttaaaagactttaaggagttcgctagcggccgcaaatcgatcactctggatattctcacggaaatcgcatctctgcccacctacctttccagccgggccaagctggctctcgacaacatcgtcatgttgcatacaactgagcgagggggcagagcctaccagcacgcactgaatgaactaccagagtcactggagaccctcatgcttgtagcgctgttaggtgccatgacagctggcatatttttgttctttatgcaggggaagggaataggcaaactgagtatgggtctcatcaccattgccgtggcatctgggctgctttgggttgctgaaatccagcctcaatggattgccgcatccatcatactggagttctttctcatggtgttgctgatccccgaaccagagaagcagaggactcctcaggataaccagttaatttatgtcatcctaacaattctgacgatcataggcctcattgccgctaatgaaatgggacttatcgagaaaaccaagactgacttcggcttttaccaagtgaaaacagagaccaccattctggatgtcgacttgcgcccggcgagcgcctggacactgtatgcagtggctactacgatcctcacccccatgctgcggcacacaatagaaaacacttcagccaatcttagtctcgccgcaatcgctaaccaggccgcggttctgatggggttgggaaagggctggccactgcatagaatggatttaggtgtgcctctactggctatggggtgttacagccaggtaaatcccaccacactcaccgcctcccttgtgatgctgttggtccactatgcaattatcggaccaggcctgcaggccaaagctactcgtgaggcacaaaagaggacggccgcgggtattatgaagaaccctacagttgacggcatcaccgtgatagatctcgaacccatttcttacgacccgaaattcgagaagcagctggggcaggtcatgcttttagtgctgtgcgctggacaactcttgctgatgcggactacctgggccttctgtgaggtactaacactggcaactggcccaatcctcaccctttgggaagggaatcctggacgcttttggaacacaacgatcgccgtgagcaccgctaacattttccgaggctcctatctggccggtgcagggttggctttttcactgatcaaaaatgcccagactcccagaaggggaacaggcaccactggtgagacactcggcgaaaagtggaaacggcagctgaactctttagaccgcaaggagttcgaagagtacaagagaagtgggatacttgaggttgataggaccgaagcgaaatcggccctgaaggacggaagcaaaattaagcatgcagtgtcccgaggatcttcaaaaatccggtggattgtcgagcgtgggatggtgaagccaaagggaaaagtcgtggatctcggctgcggtagagggggatggagctactatatggctacgctaaagaatgttaccgaagtaaaaggctacacaaagggcgggcccggacacgaggaacctatcccgatggccacttatggttggaacctggtgaaattgcattccggcgtcgacgtgttttacaagcccaccgagcaggttgatacactgctctgtgacataggggagagttctagcaatccaactatcgaagagggacgcacccttagggtgctgaagatggtcgaaccttggttgtcatccaaacccgagttctgcattaaggtgctgaacccttatatgccaacagtaatcgaagaactcgagaaattacaacggaagcacggcggtaatctggtgagatgtccccttagtcgcaacagcacccacgaaatgtactgggtttctggggcatccggaaatattgtctcaagcgtgaacactacgtcgaaaatgctgctaaataggtttacaacccgacatcggaagcctacttatgagaaagatgtggacctcggcgctggcaccagatctgtcagtacagaaacggagaagccagatatgaccatcattgggaggcgcctgcagcgtttgcaggaggaacacaaggagacttggcattacgaccaggaaaacccctaccggacatgggcctatcacggatcctacgaggccccgagcaccggttcagcgtcctctatggttaatggcgtggtaaaactgctcactaagccttgggatgtgatcccaatggtcacacaacttgctatgaccgacacaactcccttcgggcagcagagagtgtttaaagaaaaggttgacaccaggacgcctcagccaaaacccggaacccgcatggtgatgacaactaccgcaaactggctgtgggccttactgggcaagaagaaaaatccgcgattgtgcacacgggaggagttcataagcaaggtcagaagtaacgctgccattggtgcagtgtttcaagaagaacaggggtggacttccgccagcgaagctgtatctgattcaaggttctgggagctcgttgacaaagaacgcgcgctgcaccaggagggaaagtgtgagagttgcgtgtataatatgatgggcaaaagagaaaagaagctaggcgagtttgggcgggccaaaggatccagggcaatctggtacatgtggcttggtgctcgtttcctggagttcgaggccctcggctttctgaacgaagatcattggttcgggcgagagaacagctggtctggagtcgagggcgaaggtttgcaccgcctggggtatatcctcgaggaaattgacaagaaagatggagaccttatgtacgcagatgacaccgccggctgggatacgagaataacagaggacgatctgcaaaatgaggaattaatcaccgagcagatggctcctcatcacaagattctggccaaagcgatctttaagttgacttatcagaacaaggtggtgaaagtcctccggcccacaccaaggggcgcagttatggacattatctcgcgcaaggatcagagagggtcaggacaagtgggtacctacggcctgaatactttcaccaacatggaagtacagctaatacggcagatggaggccgaaggggtgatcacacaggacgacatgcaaaatcctaaaggacttaaggagagggtcgagaaatggctgcgagaatgcggcgtggatcgtctcaagagaatggctattagcggtgacgattgtgttgtgaaacccctggacgagcgctttgggacgtccttgttattcctgaacgatatgggaaaggtccggaaggacatcccacagtgggaacccagtaaaggctggaagaattggcaggaggtgcctttttgctctcatcacttccacaaaatttttatgaaggatggcaggagcctcgtagttccatgtagaaaccaggacgaacttatcgggcgcgcccggatatcccaaggagcaggttggtcactgagggagaccgcttgcctaggcaaagcctacgctcagatgtggagtctgatgtatttccatcgaagagatctccggttggcctctatggcaatttgtagcgcggtgccgactgagtggtttcccacatccaggaccacttggtcaatccacgcccatcaccagtggatgacaaccgaagacatgctgaaggtctggaatcgcgtgtggatcgaggataaccctaatatgattgacaagacgccagttcacagctgggaagacataccctaccttgggaaacgtgaggatctgtggtgcggatctctcatcggcttatccagtagagctacatgggccaagaacattcataccgcaatcactcaggtgcgaaatctgattggtaaagaagagtatgtcgactacatgcctgtgatgaagaggtatagcgctccatcggagtccgaaggggtattgtga

SEQ ID NO: 15697 - RNA, 9867 nt, synthetic construct
  misc_feature 1..9867: note = derived and/or modified CDS sequence (opt3) from DENV-4__GQ868585__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatgaaaaccacatgtttgccggacatcttaagtgtaaggtacggatggagaaactgcgaatcaagggcatgagctatacaatgtgcagtggtaaattctctatcgacaaggagatggctgaaacgcaacacgggaccactgtcgtgaaagttaagtacgagggcgccggagcaccttgtaaggtgccaattgaaatacgcgatgtcaataaagagaaggtggtaggcagagtgatctccgccacacccttggctgagaacaccaacagcgttacaaatattgaactcgagccgcctttcggggactcgtatatcgtcataggagtgggtaactctgcgctgactttacattggtttaggaaaggctcctcaattgggaagatgttcgaaagtacctaccggggagcaaaacgcatggccatcctgggcgagacggcttgggattttggtagcgtggggggcctattcacctccctcggaaaggccgtccaccaggtttttggctctgtgtatacaactatgttcgggggagtgagctggatgatcagaattctgatcggctttcttgtattgtggattggtaccaattcaaggaacacaagtatggcaatgacttgcatagccgtcgggggaatcaccctgttcctcggctttacggtgcaggctgacatgggttgtgttgtgtcctggagcggccgtgaactgaagtgcgggtctggaattttcgtcgtggataatgttcatacatggaccgagcaatacaaatttcagcccgagtcaccagcccggcttgcaagtgcgatcctgaacgctcacaaggacggcgtgtgtgggatccgaagcactacaagattggaaaatgtaatgtggaaacagattaccaacgagctcaattatgtcctgtgggaaggaggccacgacttaactgtggtggccggtgatgtcaagggggttctgaccaaaggaaagagggcactaacacctcccgcctccgacctcaagtactcttggaaaacgtggggcaaggctaaaatattcaccccagaggcccgcaactcgacttttctgatcgatggtcccgacacaagcgaatgccctaatgagcggagagcatggaactccttcgaggtggaagattacggcttcgggatgtttaccacaaatatttggatgaagttcagggagggatcaagtgaagtatgtgaccatcgccttatgtctgctgccatcaaagatcagaaggcggtgcacgccgacatgggctattggattgagagctccaaaaaccaaacttggcagatcgaacgagcttcattgatagaggtcaagacctgcctgtggccaaagacgcatacactctggagcaatggggtgctggagtctcagatgttaatcccgaaatcctacgcaggaccctttagtcagcacaactatcggcaaggctacgccacccagactgttggtccttggcacctggggaagcttgaaattgatttcggagagtgcccaggcaccacagtgactatccaggaaaactgtgaccatcgtggtcccagcttgagaaccacaacggcttctggcaaactcgtcacccagtggtgctgtaggtcctgcactatgcctccactgcgctttctaggggaggatggatgttggtatggcatggagattcggcccctgtcagaaaaggaggaaaatatggtgaaaagtcaagttacagccgggcagggaaccagcgagactttctcgatgggcctcctgtgccttacattgtttgtggaagagtgtctgagaaggcgagtcacccgcaagcacatgatcttagcagtagtgataacgctctgcgcgattatcctgggtgggcttacttggatggacctgttgcgggccctcattatgctgggagataccatgtccggcagaatcggcgggcagacacatctagctataatggccgttttcaagatgtctccgggatacgtgctgggtgtctttctcaggaaactgaccagccgtgagactgcacttatggtgatcggcatggctatgacaaccacattgtcaattcctcacgacctgatggaattaatcgacgggattagtctcggactgatccttctgaagatagtaactcagttcgataacacccaagtgggcacgctagccctctccctgacatttattcgctctaccatgagcttggtcatggcatggcggactatcatggccgttctgttcgtggtgaccttaatcccactctgtagaacatcctgcctgcagaaacagtcacattgggtcgagattactgctcttatcctgggtgcgcaagccttgcccgtgtatctcatgaccctgatgaagggggcaagcaggcgaagttggcctctaaatgaaggaattatggctgttggcctggtatctcttctcggctccgccctgttgaaaaacgacgtgcccctggccgggccaatggtcgctggaggtttactcctggcagcctacgtgatgagcggctcgtcagcggatctttctctggagaaggctgccaatgttcagtgggacgaaatggcagatataacggggagttcccctatcattgaggtgaagcaggacgaggatggaagcttttctatccgggacgtcgaagagacaaacatgattaccttgctcgtgaaactggccctaatcactgtaagcggcctgtacccccttgctataccaatcacaatgaccctctggtatatgtggcaggtcaagactcaacgctccggtgcactgtgggatgtgccgtcacctgccgcgacacagaaagctgccttgagtgaaggggtttacagaattatgcagaggggattattcggcaagacccaggtgggcgtcgggatccacatggagggagtgttccacacgatgtggcatgttactcggggtagcgtgatttgtcacgaaaccggccgactggagccctcttgggcagacgtcagaaatgatatgatctcctatgggggaggctggcgcctcggtgacaaatgggataaggaggaagacgtgcaagtactggccatagagccagggaagaaccccaaacatgtgcagacaaagcctggactttttaaaaccctgacaggcgaaattggcgctgttactttggacttcaagccagggacctcaggaagtcccatcatcaataggaaaggtaaggtcattggcctatacgggaacggagtggtgacgaaaagcggcgattatgtctccgccataacacaggcagagcgtatcggtgagcctgactacgaagtagatgaggacatttttcggaagaagagactgactatcatggatctccacccgggggctggaaaaaccaagaggattctgccatctatcgtgcgcgaagcccttaaacgaagattacggacactgatactcgcgcccaccagggttgtggccgcagagatggaagaggctttgcgcggcctgcctatccgttatcagactccagccgtcaagtcggagcataccggcagagaaattgtggacctcatgtgccacgctacattcacgactcggctgcttagctcaaccagggttcccaattacaacctgatcgtgatggatgaggcacactttacagacccttccagtgtcgccgcccgcgggtacatttctacccgagtggaaatgggagaggctgcggcaatcttcatgactgccacaccgcccggtgctaccgatccatttcctcaaagcaattcccccatagaagacattgagagagagatcccagaacggtcatggaacacgggcttcgattggatcactgactatcaggggaaaacagtatggtttgtgccttctattaaggccggaaatgacatcgcaaactgcttgaggaagagcggcaaaaaggttatacagctaagtcgcaaaaccttcgataccgagtaccccaagactaaactgacagactgggattttgtcgtgaccacagacatttccgaaatgggtgccaacttcagagctgggagggtgatcgatccacggcgttgtctcaagccggtcattttaactgacggccctgagcgcgttatcctggcgggacccataccagtgacgcccgccagcgcagctcaacgaagaggcaggattgggcggaatcctgcccaggaagatgaccagtatgtattctctggagatccacttaagaacgacgaggatcatgcacactggaccgaggccaaaatgctgctcgacaatatctacacacccgaaggtatcattcctactttgtttggcccggagcgcgaaaagacccaggctatcgatggggagttcagactgaggggagagcaacggaaaacatttgtggaactcatgcgaagaggcgacctgccagtctggctttcatataaggtggcctccgcgggtattagttacaaagaccgcgagtggtgcttcaccggggaaaggaacaatcagatactagaggaaaacatggaggttgagatctggactcgggaaggcgagaagaagaaactgcgtcccaagtggttggatgcaagagtgtatgccgaccctatggctttaaaagattttaaggaattcgccagcggaaggaaatcgattacgctggacatcctcaccgagatcgcttctctgcccacatacctttccagccgcgcaaagctggccctcgataatattgtcatgttgcatactaccgaacggggcgggcgagcttaccagcacgccctgaacgagctaccagagtcactggaaacactcatgcttgtagcactgttaggagcgatgaccgccggtatatttttgttctttatgcagggcaaggggatcggaaaactgagtatgggcctcattactatcgctgtggcctctggtctgctttgggttgcagagattcaacctcagtggatcgctgcctccataatcctggaattctttctcatggtgttgctgattcccgagccagaaaagcagagaacacctcaggacaatcaattaatctatgtcattctaacgatcctgaccataattgggctcatcgcagccaacgagatgggccttattgagaaaactaagacagatttcggattttaccaggtgaaaaccgaaaccacaatcctggacgtcgatttgaggccggctagcgcgtggactctgtatgccgtggcaacgaccatactcacacccatgctgcgccacactatcgagaatacctcagctaaccttagtctcgccgccattgcaaatcaggctgccgttctgatgggcttggggaagggatggccactgcatcggatggacttaggcgtgcctctactggcgatgggttgttacagccaggtaaaccccacaaccctcactgcttcccttgtgatgctgttggtccactatgccatcattgggccaggactgcaagcaaaagccacgagagaagctcagaagcgtacagcagccggcatcatgaagaatcctaccgttgatggtataactgtgattgacctcgagcccatctcttacgatccgaaattcgagaagcagctgggccaagtcatgcttttagtgctgtgcgcggggcagctcttgctgatgaggaccacatgggctttctgtgaagtactaactctggccaccggaccaatcctcacactttgggagggcaaccctgggcggttttggaacacgaccattgcagtgagcactgccaatatcttccgcggatcctatctggctggcgccggtttggcattttcactgataaaaaacgctcagacaccccgaagagggaccggaactacaggcgaaaccctcggtgagaagtggaaaaggcagctgaattctttagaccggaaggaattcgaggagtacaagcgcagtggcattcttgaagttgacagaacggaggccaaatcggcgctgaaggatgggagcaaaatcaagcatgccgtgtccaggggatcttcaaaaattcgatggatcgtcgaacggggcatggtgaagccaaaggggaaagtcatagacctcggatgcggccgtggtgggtggagctactatatggcaaccctaaagaacgtgacagaggttaaaggatacactaagggcggccccgggcacgaagagcctatcccgatggctacctatggatggaatctggtaaaattgcattccggtgtggatgtcttttacaagcccacagagcaagtggacactctgctctgtgatattggcgaaagttctagcaacccaaccatcgaggaagggagaacacttcgcgttctgaagatggtggagccttggttgtcatccaaacccgaattctgcattaaggtcctgaatccttatatgccaaccgtgatcgaggagctcgaaaaattacagaggaagcacggaggcaacctggtacggtgtccccttagtagaaatagcactcacgagatgtactgggtgtctggtgcctccgggaacattgtttcaagcgtcaatacgacatcgaaaatgctgctaaaccgctttaccactaggcatcgaaagcctacctatgaaaaagacgtggatctcggagcaggcacacggtctgtgagtacggagaccgagaagccagacatgactatcataggcagaaggctgcagcgcttgcaggaagagcacaaggaaacatggcattacgatcaagagaatccctaccgtacctgggcttatcacgggtcctacgaagccccgagcactggatcagcctcctctatggtcaacggtgttgtgaaactgctcacaaagccttgggacgtaattccaatggtgacccagcttgcgatgacagatactacccccttcggccagcagcgggtctttaaagagaaggtggacacgagaacccctcaaccaaaacccgggacaaggatggttatgactaccacagctaattggctgtgggcattactgggaaagaagaaaaacccgcgcttgtgcactcgagaggaattcatcagcaaggtgcggagtaatgccgctatcggcgccgtctttcaggaggaacagggttggacctccgcaagcgaggccgtgaacgactctagattctgggaactcgtagataaagagagggctctgcaccaagaggggaagtgtgaatcatgcgtttataacatgatgggaaaacgcgagaagaagctaggcgaatttggcagagcgaaagggagtcgggccatttggtacatgtggcttggagcaaggttcctggagttcgaagctctcggttttctgaatgaggaccattggttcggccgtgagaactcctggagcggggtggaaggagagggcttgcaccgactgggttatatactcgaagagatcgataagaaagacggggatcttatgtacgccgacgatacggcaggatgggacacacgcattaccgaggatgacctgcagaatgaagagttaatcactgaacagatggcccctcatcacaagattctggctaaagccatctttaagttgacatatcagaacaaggtcgtgaaagtgctcagacccaccccacggggcgcggtcatggatataatctctaggaaggaccaacgcggctcggggcaggttggaacttacggtctgaataccttcacaaacatggaggtgcagctaattagacagatggaagcagagggcgtaatcacgcaagatgacatgcagaatcctaaagggcttaaggagcgggtggaaaaatggctgagggagtgcggagtcgaccgactcaagcgtatggccatttcaggcgatgactgtgtggttaaacccctggatgaaagatttggtaccagcttgttattcctgaacgacatggggaaggtgcgcaaggatatcccacagtgggagccctccaaaggatggaagaattggcaggaagtccctttttgcagtcatcacttccacaaaatatttatgaaggacggccggtctctcgtggtaccatgtaggaaccaagatgagcttattggcagagctcgcatcagccagggggccggatggtccctgcgggagactgcatgcctaggtaaagcttacgcccagatgtggtcactgatgtatttccataggcgagacctcagattggctagtatggccatctgttctgcagttccgacagaatggtttcccaccagccggactacatggtccattcacgcgcatcaccagtggatgaccacggaggatatgctgaaggtgtggaatagggtctggatagaagacaaccctaatatgatcgataagacaccagtgcactcatgggaggacattccctaccttggcaaacgcgaagacctgtggtgcgggagcctcatcggattatcttcccgtgccacctgggctaagaacattcatactgccatcacccaagttagaaatctgataggcaaagaggagtatgtggattacatgcctgtcatgaagcgatatagtgcaccaagcgaatcggagggtgtgttgtga

SEQ ID NO: 15698 - RNA, 9867 nt, synthetic construct
  misc_feature 1..9867: note = derived and/or modified CDS sequence (opt3) from DENV-4__JQ922560__SS-prME
  source 1..9867: mol_type = other RNA
agcaccatcacactgctctgccttattcccactgtgatggccttccacctgtccacgagagacggcgagcctttgatgatagtcgctaagcatgaaagggggcggcgcttactgtttaaaaccacagagggaatcaacaagtgtactctaattgcaatggatctcggtgaaatgtgcgaggacaccgttacatacaaatgtccactgcttgtgaataccgaaccggaggatatcgactgctggtgtaacctgacttctgcctgggtaatgtatggcacatgcacccagtcaggggagcgacgtagagaaaagaggagtgtggcgttgacgccccacagcggaatgggcctcgagactcgggctgaaacctggatgtcctctgagggtgcctggaaacatgcacaacgcgtcgagtcgtggattctgagaaatcctgggttcgccctgctcgctggatttatggcatacatgatcggccagacaggcatacagaggactgtgttctttatcttaatgatgctggttgccccatcatatgggatgcggtgtgtgggagtcggtaaccgcgatttcgtggaaggcgtaagcgggggagcttgggttgaccttgtgttggagcacggcggttgcgtcaccacaatggcccaggggaagcccaccctggattttgaactaattaagacgactgcgaaagaggtggcactcctgcgaacatactgtatcgaagccagtatttccaatatcaccactgctacaagatgccctacccaaggagagccatatcttaaggaggaacaggaccagcagtacatatgtaggcgggatgtggtcgaccgtggctggggcaacgggtgcggactgttcggtaaaggcggggttgtgacgtgcgccaagttttcttgtaccggaaaaattacaggcaatttgatccaaattgagaacctcgaatatactgtagtggtcaccgtgcataatggtgatacacacgcagttgggaacgacactagcaatcacggcgtgaccgctacaatcaccccccgctccccttcagtcgaggtggaactgccagattacggagagttaactctggactgcgagccgagaagtggcatcgacttcaacgaaatgattctcatgaagatgaataagaaaacgtggcttgtacataagcagtggtttctggatttgcccctaccttgggccgcgggggccgacacaagcgaggttcactggaaccataaagaaaggatggtgaccttcaaggtcccacacgcaaaacggcaggatgtgactgtcctgggatctcaggagggtgctatgcactccgccctcaccggcgctacagaagtgtactcaggggacggaaatctgatgtttgccggccatcttaagtgtaaagttcgaatggagaagctgcgcataaagggtatgagctataccatgtgcagtgggaaattctctatcgataaggagatggcagaaactcaacacggcacaacggtggtaaaagtcaagtacgagggagccggcgctccctgtaaagtgcctattgaaatcagagacgttaacaaggagaaggtggtcgggagggtgatatccagcaccccattcgcggagaacactaattcggtaacaaacattgaattggagcccccgtttggagattcttatatcgtgatcggtgttggcgactccgcactcaccctgcattggttcacaaaagggtcaagtattggaaagatgtttgaaagcacttaccggggcgccaaacgcatggctatcttaggtgagaccgcctgggatttcgggtccgtcggcggactgctaacgtctctcggcaaggcagtgcaccaggtgtttgggagcgtctataccacaatgttcggaggcgtttcatggatggtgagaattctgataggttttcttgtgttgtggatcgggactaatagtaggaacacctccatggccatgagctgcattgctgtaggaggcatcacactgttcctcggttttactgtccatgccgacatgggctgtgcagtgtcttggtcagggaaagaactgaagtgcggaagtggcatcttcattatagataatgttcacacctggacggagcagtacaagtttcaacctgagagccccgcgcgtcttgcttccgccatcctgaacgcacacaaagacggggtgtgtggaattcggtctacaacccgattggaaaatgtcatgtggaagcagatcactaacgagctcaattatgtgctgtgggaaggcggtcatgacttaacagttgtggccggggatgtaaaaggagtcctgtcgaagggcaaaagagctctagccccacctgtgaacgacctcaagtacagctggaagacctggggtaaagcaaagattttcactcccgagaccaggaattccacatttctgatcgatggcccagacacgtcagaatgccccaacgagcgccgggcttggaatttccttgaggtggaagattacgggttcggaatgtttaccactaacatatggatgaaattcagagagggcagttctgaaatgtgtgaccacaggttgatgagcgccgcgatcaaggatcagaaagccgtccatgctgacatggggtattggattgagtcctcaaagaatcagacatggcaaatcgaaaaagcaagcctgattgaggttaagacctgcctctggcctaagacacacactctgtggtctaacggagtgttagagtcccagatgctgatcccaaaagcctacgctggcccgtttagtcagcacaactatcgccagggttacgccacccaaacggtagggccctggcatcttggaaagttggaaatagatttcggcgagtgccctggtacaaccgtgactattcaggaagactgtgatcaccgaggcccaagcctccggaccacaactgcatctgggaaactggtcacccagtggtgctgtcgttcctgcacaatgccccctctaagatttctgggagaggacggctgttggtatgggatggagatcaggccactctcagaaaaggaggaaaatatggtgaaaagtcaggttagcgcgggacaaggcacgtcggagaccttctccatgggtctgctttgcttgactctgtttgtggaagagtgtttacgccggagagtcacaaggaagcatatgattctcgtggttgtgaccactctgtgcgccatcatacttgggggactgacatggatggatttgctccgagctctgatcatgctaggcaacaccatgtctagccgcatgggcgggcagattcacctggccatcatggcagtcttcaagatgtcacccggatacgtactcggtatttttctgcggaaacttacgagtagagagactgctttgatggtgatcggcatggccatgaccacagttctgtccataccgcatgacttaatggaattcgtggacgggatttctctcggactgatccttctgaagatggtcacccactttgataatactcaggtgggcacactagcactcagcctgaccttcatcaaatccacaatgcctttggtaatggcctggaggactattatggctgtgctgtttgtcgttaccttaatcccactctgtcgtacgtcatgcctgcagaagcaaagccactgggtggagattacagcgcttatactgggtgcccaggcattgcccgtgtatctcatgaccctgatgaaaggggctagtaagcgctcttggcctctaaacgaaggaatcatggccgtcggcctggtgtcccttctcggcagcgccctgttgaagaatgacgttcccctggctgggccaatggtagcaggaggtttactcctggccgcgtacgtgatgtcgggctcatctgctgatcttagtctggagaaagccgcaactgtccagtgggacgaaatggccgatattaccgggtccagccctatcattgaggtgaagcaagacgaggatggatctttcagcatccgggacgttgaagagacaaacatgataactttgctcgtgaaactggctctaatcaccgtctccggcctgtacccccttgcaattccagtgacgatgacactctggtatatgtggcaggtaaagacccagagatcaggtgccctgtgggatgtcccgagtcctgcggctgcccagaaagcaactttgacagaaggggtgtacaggatcatgcaacgaggattattcggcaagacccaggttggcgtggggattcatatggagggagtctttcacactatgtggcatgtgacacggggtagcgttatctgtcacgaatctggccgcctggagccctcctgggccgacgtgagaaatgatatgatatcatatgggggaggctggaggctcggtgacaagtgggataaagaggaagacgtccaggtgctggctgtagagccagggaagaaccccaaacatgtgcagaccaagcctggacttttcaaaacgctgactggcgaaattggcgccgttaccttggactttaagccagggacaagtggaagccccatcatcaatcggaaaggtaaggtcattggcctatacgggaacggagtggtgaccaagtccggcgattatgtctctgcaataacacaagctgagcgaatcggtgagcctgactacgaagtagatgaggacattttcagaaaaaagcgcctgactatcatggatctccacccgggggccggaaaaaccaagaggattctgccatcgatcgtgcgtgaagcgcttaaacggagattaaggacgctgatactcgcccccacacgcgttgtggcagctgagatggaagaggccttgcgaggcctgcctatcagatatcagactccagctgtcaagagcgagcacaccggccgggaaattgtggacctcatgtgccatgcaacatttaccactaggctgctttcatccacccgcgttcccaattacaacctgatcgtgatggatgaggcccacttcacagaccctagttctgtcgccgctcgtgggtacattagcacgagagtggaaatgggagaggcggcagccatctttatgactgctaccccgcccggtacaaccgatccattccctcagtccaattcacccatagaagacattgagcgggagatcccagaaaggtcttggaacactggctttgattggatcacagactatcaggggaagaccgtatggttcgtgcctagcattaaagccggaaatgacatcgcaaactgcttgcgcaagagtggcaaaaaggttgtccaactatcccgaaaaacgtttgatactgagtaccccaagacaaagctgaccgactgggatttcgtggtgaccactgacataagcgaaatgggtgccaacttcagagctgggcgggtcattgatccaaggcgctgtctcaaaccggttatcattacagacggccctgagagagtgatcttagcgggacccataccagtaacccccgcctctgcagctcagaggcggggccgtattgggcgcaatcctgcccaggaagatgaccaatatgtgttttcaggagatccactgcgaaacgacgaggatcatgcacactggacagaggccaagatgcttctggacaatatctacactcccgaaggtatcattcctacgctcttcggcccggagagagaaaaaacccaggctatcgatggggagtttaggttgcggggagagcagcgcaagacattcgtcgaactgatgagaaggggcgacctcccagtgtggctgtcctataaagttgccagtgcgggtattagctacaaggaccgggagtggtgctttactggggaacgaaacaatcagatacttgaggaaaacatggaggtggagatctggaccagagaaggcgagaagaaaaagctacgccccaaatggctggatgcaagggtctatgccgaccctgtagctttgaaggatttcaaagaatttgcctcgggacggaagtctattacattagacatcctgaccgagatcgcttccctccccacttacctgagctcacgtgcaaagcttgccctggataatattgtgatgctccacacgaccgaaagaggcgggaaagcttaccaacatgccttgaacgagctgccagagagtctagaaacactgatgctcatagcacttctgggagcgatgactgccggtatcttcttatttttcatgcagggcaaggggatgggaaaattgtctatgggcctgattgctatcgccgttgcatccggtctcctgtgggtggctgagattcagcctcagtggatcgccgcaagcataatccttgaatttttcctgatggccctcttgattcccgagccagaaaagcaaaggacccctcaggacaatcagctgatctatgtcattttaacaatcctaaccataattgggctggtggctgcgaacgagatgggcctcatcgagaaaactaagacagattttggattctaccaggaaaaaacggagaccactattcttgacgtcgatctgcgcccggcctcagcatggacattgtatgctgtggccaccaccatcctgacacccatgctccggcacactatagaaaatacgagtgccaacctgagccttgcagctatcgccaatcaagcggctgttctcatgggcctggggaagggatggccattgcatcgaatggacctgggcgtgcctttactagccatgggttgttactcccaggtaaaccccaccacactgactgcatctctcgtgatgcttctggtccactatgccattatcgggccaggattgcaggctaaggcaaccagagaggcccagaaaaggacagcggctggcattatgaagaatcctaccgttgatggtatcactgtgatagacctggagcccattagctacgatccgaaattcgaaaagcaactcggccaggtcatgctgcttgtgttatgcgccgggcagctgctcttgatgcgcacgacatgggcattttgtgaggtactgaccctagccactggaccaatcctgaccctctgggaaggcaaccctgggcggttctggaacacaactatcgctgtgtccaccgccaatatttttagaggatcatatcttgcaggcgctggtctggccttctctttgatcaaaaacacacaaacgccccgtagggggaccggaactacaggcgagaccctgggtgaaaagtggaagcggcagctcaatagtctggaccgcaaagagtttgaggaatacaagcgatcgggcatattagaggttgacagaactgaagcgaaaagcgcccttaaggatgggtccaaaattaagtacgcagtgtctaggggaacatcaaagatccggtggattgtcgagcgcggcatggtgaaaccaaaggggaaagtcgtggacctgggatgcggcagaggtgggtggagctattacatggctaccctcaagaacgttacggaagtaaaaggatataccaagggcggccccgggcatgaggagcctatcccgatggccacatacggatggaatctagtgaagctgcactccggtgtcgatgtgttctataaacccactgaacaggttgacaccttgctgtgtgatataggcgagagttctagcaacccaacaatcgaagaggggaggactctccgagtgcttaagatggtcgaaccttggctgtcatccaaacccgagttttgcattaaggtgttgaatccttacatgccaaccgtaatcgaggaactggagaaactccagcggaagcacggaggcagtttagtgcgttgtcccctgagcagaaactctacacatgaaatgtattgggtttccggtgtctcacgcaatattgtgagctcggtgaacaccacttctaaaatgcttctgaataggttcacgacacggtacagaaagcctacctacgagaaggacgcagatctaggggctggaactcgcagtgtctccaccgagacagaaaaaccagacatggccatcattggcaggcgactccaacggctgcaggaggaacacaaggagacgtggcattatgatcaggaaaacccctacagaacctgggcctatcacggcagctacgaggcgccgtcaactgggtccgcttctagcatggttaatggagtggtaaaattgctgacaaagccttgggacgtggtcccaatggtgacccagctcgcaatgactgatacaaccccctttggtcaacagagggttttcaaagagaaggtggacacacgcactcctcagccaaagcccggcacccgtatgatcatgacgaccacagccaactggctttgggctctgttagggaaaaagaaaaatccgcggctgtgcactagagaagagtttataagtaaggtcaggtccaacgccgcaattggagccgtgagccaggaagagcaaggctggacctctgcttcagaagcggtaaatgacagtcgcttctgggagttggttgataaagagcgagccctccaccaggaaggtaagtgtgagtcctgcgtgtataacatgatggggaagcgggaaaaaaagctgggagagtttggcagagcaaaaggcagcagggctatctggtacatgtggctaggggcccgcttccttgaattcgaggcactgggatttctcaacgaggaccattggttcggtagagaaaattcttggtcgggcgtcgagggggaaggactgcaccggttgggctatatcctggaggatattgacaagaaagatggtgacctcatatacgccgatgacacagctgggtgggatactaggatcaccgaggacgatcttctgaacgaagagttaattacggaacagatggcccctcatcacaagatcctggcgaaggcaatttttaaattgacataccaaaataaggtggtgaaagtcctccgtcccaccccaaagggagccgttatggacatcatatcacgaaaagatcagcgcggcagcggccaggtggggacttatggactgaacacattcaccaatatggaggtacagctaatcagacaaatggaagctgagggtgtgattactcgggacgacatgcataaccctaagggccttaaagagagggtcgaaaagtggctgaaggagtgcggggtggatcgcctcaaaagaatggccatctccggagacgattgtgttgtgaagcccctggacgaacggtttagtacctctttgttattcctgaatgatatgggcaaagtcaggaaggacattccacagtgggagcccagcaaaggttggaagaactggcaggaagtgcctttttgctcccaccacttccataagatctttatgaaagatgggcgatcactcgtagttccatgtcgtaatcaggacgagcttataggaagagcacgcattagtcaaggcgctggctggtctctgcgggagacagcctgcctagggaaggcttacgcccagatgtggagcctgatgtatttccacaggagagatctccgcttggcatccatggcgatctgttcagccgtgccgacggaatggtttcccaccagccggactacatggtctatccatgctcaccaccagtggatgaccactgaggacatgctgaaagtctggaacagggtgtggattgaagataatcctaacatgacagacaagaccccagttcattcctgggaggacataccctaccttggaaaacgagaagatctgtggtgcggtagtctcatcggcttaagctcgagagccacgtgggcaaagaatattcacacagctatcacccaggtgcggaacctgattgggatcgaggagtatgtcgactacatgcctgtgatgaagaggtattccgccccattcgaatctgagggagtattgtga

SEQ ID NO: 15699 - RNA, 9867 nt, synthetic construct
  misc_feature 1..9867: note = derived and/or modified CDS sequence (opt3) from DENV-4__JQ922558__SS-prME
  source 1..9867: mol_type = other RNA
agcaccctgacactcctttgcctgatccccactgtgatggccttccacttgtccacgagagacggcgaacctttaatgattgtcgctaagcatgaaagggggcggccactgttatttaaaaccacagaaggaataaacaagtgtactctcatcgcaatggatctgggtgaaatgtgcgaagacaccgttacatacaaatgtccgcttctggtgaataccgaacccgaagatattgactgctggtgtaacttgacttctacatgggtgatgtatggaacctgcacgcagtcaggggagcgccgacgtgaaaagagaagtgtggccctcactcctcacagcggaatgggcctggagaccagggcggaaacatggatgtcctctgagggtgcttggaaacatgcccaacgggtcgagtcgtggatcctgcgcaatccagggttcgcactcttagccggatttatggcttacatgattggccagactggcatccagagaaccgtgttctttgttctgatgatgcttgtggcaccctcatatgggatgaggtgtgtcggagtgggtaaccgggatttcgtagaaggcgttagcgggggagcctgggtggacttggtcctggagcacggcggttgcgtgacaaccatggctcaggggaagcctacgctagattttgaactcataaagactacagccaaagaggtggcgctgcttcgcacctactgtatcgaagcaagtatttccaatatcactacagccacccgatgcccaacgcaaggagagccctatctgaaggaggaacaggaccagcagtacatttgtagaagggatgtcgttgaccggggctggggcaacgggtgcggattgttcggtaaaggcggggtggtaacctgcgctaagtttctctgtctgggaaaaatcacaggcaatttagtgcaaatagagaacctggaatatactgtcgtggttaccgtgcataatggtgatacacacgccgtcgggaacgacatttctaatcacggcgtgactgcaaccatcacacctcgtagcccatccgtagaggttaagctcccggattacggagaacttaccctggactgcgagccccgctcaggcattgacttcaacgagatgatcttgatgaagatgaaaaagaaaacttggctagtgcataagcagtgggtcctggatctccctctgccatgggctgccggggcggacacgagtaaagtgcagtggaattacaaggaaagaatggtcacatttaaagtgccccacgccaagaggcaggatgttaccgtgcttggaagccaagagggtgcaatgcattctgctctgactggcgccaccgaagtagactccggggatggaaaccacatgttcgctggccacttgaagtgtaaagtccggatggagaagctccgaatcaaaggtatgtcatatacaatgtgcagcgggaagtttagtattgacaaagaaatggccgagacccagcatggcactacagtggttaaggtgaagtacgagggagcaggcgccccttgtaaagtcccaatagaaatccgcgatgtgaataaggagaaagtagtggggagaattatctcttccacgcccttcgctgaacacaccaacagcgttactaacatagagctggagccgcctttcggagactcgtatattgtcatcggtgtgggcgattctgcgttaacactgcattggtttaggaaggggtcctcaatcggaaaaatgttcgaaagtacctaccggggcgcaaagcgcatggccattctaggtgagacagcttgggactttgggagcgtgggcggactcttcacttccctgggcaaggccgtccaccaggtttttgggtctgtgtataccacgatgttcggaggcgtgagctggatggtaagaatccttattggtttgctggtcctctggatagggaccaattcaaggaacacaagtatggcaatgacttgcatcgccattggaggcatcaccctgtttcttggtttcacagtgcatgctgatatgggctgtgccgtttcctggagcgggaaagaactgaagtgcggatctggcatctttgtggtcgacaatgtgcacacttggaccgagcaatacaaattccagcccgaatcaccagcacgtttggcgagtgctattctcaacgcccacaaggacggggtttgtggaatacggagcacgacacgactggagaatgtgatgtggaaacagatcaccaacgagttaaattatgtactgtgggaaggcggtcatgatctaactgtcgtggcaggggacgtgaagggagtcctcacaaagggcaaaagagccctgacccctcccgttaacgatcttaagtactcctggaaaacttggggtaaggctaaaatttttaccccagaggccagaaattctacattcttgatcgacggccccgatacgtcggaatgccctaacgagcgccgggcatggaattttctggaagtggaggactacgggttcggaatgttcaccactaacatttggatgaagtttagagagggcagctccgaagtatgtgatcacaggctcatgtcagctgccatcaaagaccagaaggcggtgcatgccgatatggggtattggatagagagttctaagaatcaaccatggcagatcggaaacgctagcctgattgaagtcaaaacatgcttatggccgaagacccacacactgtggtccaatggcgtgcttgagtcacagatgttgatccccaaagcatacgccggtcctttcagccagcacaactatcgccaagggtacgctactcagaccattggaccatggcatctcggcaagctggaaatcgactttggtgagtgccccggcacgacagttaccatacaggaggattgtaaccaccgagggccttctctacggactaccacagcctccggaaaactggtgactcagtggtgctgtcgtagttgcaccatgccacccctcagattcctgggcgaagacgggtgttggtatggaatggagattaggccgcttagcgaaaaggaggagaatatggtcaagtctcaagtgtccgcaggccagggtacatcagaaacgtttagtatggggttgctgtgcttaaccctcttcgttgaggaatgtctgcgccggagagtgactaggaaacatatgatccttgtcgtagtgacaaccctgtgcgcgattatcttgggaggcctcacttggatggatctgctacgagccctgataatgctcggcgacacaatgagcgggcgcatgggaggtcagatccacctgaccattatggctgtttttaagatgtcgcctggctacgtgcttggggtcttcttgcggaaactgacgtccagagagactgccttaatcgtgattggaatggcaatgaccacagtactctctatcccacatgacctgatggaatttatagatggcattagccttggtctgatcctactcaagatggtggctcacttcgacaacacccaggtcgggactctggccttgtcactgacatttatcaggagtaccatgcccttagttatggcatggcgtacaattatggccgtactcttcgtggtcactctgatccctctttgtcgcacctcctgcctgcaaaaacagtctcactgggtggagattacggctttgatactcggagcgcaggccctgcccgtttatctaatgacactgatgaagggcgcaagcaagcggtcctggccacttaatgagggcatcatggctgtagggctcgtgtcactgttgggaagcgccctgctcaaaaacgatgtccctctagccggtcccatggtggctggcgggctgcttctggcagcctacgttatgagtggatcttccgcggacttgagcctcgaaaaggctgccaatgtgcattgggatgagatggcagacattaccggctcgtcaccaatcattgaagtcaaacaagatgaggacggttcttttagtatcagagatgtggaagagactaacatgataaccctgctagtaaagctggcccttatcacagtctccgggctctacccgctggctattcctgtgactatgaccttgtggtatatgtggcaggttaaaacgcagaggagcggagcattatgggacgtgccctctccagccgcggctcagaaggccacactgaccgagggcgtctaccgaatcatgcaacggggcctcttcgggaagactcaggtgggagttggtattcacatggaaggcgtgttccatacaatgtggcacgtcacccgcgggagcgtgatctgtcatgagactggaagactggaaccctcctgggcagatgtaaggaatgacatgatatcatatggcggtgggtggcggcttggagataaatgggacaaggaggaagacgtgcaggttctggccattgagcctggcaaaaacccaaagcacgtccagacaaaacccggcttgtttaagaccctaacgggggagatcggagctgtgactctggatttcaaacctggtaccagtggcagcccgatcattaataagaaggggaaagtgataggactctacggcaacggtgtcgtaacaaagtctggggactatgtgtccgccatcacccaagcagaacgaattggagatccagactacgaggttgatgaagacatctttaggaaaaagcgcctgacaattatggatcttcaccccggcgctggcaaaactaagaggatcttaccttcaatagtgcgtgaggccctgaagcggagactcaggaccttgatcctggcgccaacgcgcgtcgtggccgcagagatggaagaggctctccgagggctgcccattagatatcagactcctgccgttaaaagtgaacatactggacgggagatcgtggaccttatgtgccacgctaccttcacagcaaatccgctgagctccaccagggtccccaactacaatttgattgtgatggatgaagcccatctacaggacctgtctatcgtagccgctcgcggttacatatcgactcgtgtggagatgggcgaggcggcagccatttttatgaccgctacaccacctggggccacggatcccttcccacagagcaactcacctatcgaagacatcgagagagaaattcccgagcggtcctggaatactggatttgactggatcaccgattatcaaggcaagacagtttggttcgtcccaagtataaaagcaggtaacgacattgccaactgcctcaggaagtctgggaaaaaggtgatccagttaagccgcaagacctttgatactgaatacccgaaaacaaagctgaccgactgggatttcgtggtcacgactgacatttccgagatgggcgctaattttcgagcgagacgggttatcgatcctaggcgctgtcttaaacccgtgatactgacagacggaccagagagagtaattctcgccggccccatccctgtgaccccagcatcagctgcccagaggcgggggcgtatcggacgcaaccccgcacaagaagatgaccagtatgtcttctctggtgatcctttgaagaatgacgaggatcacgcccactggaccgaagctaaaatgctgctcgacaacatttacactccggagggcatcattccaacactgttcgggcccgaacgagagaagatacaggccatcgacggagagtttagacttaggggcgaacagcggaagaccttcgtggagctaatgcgcagaggtgatctgcctgtttggttgagctataaagtggcgagtgcagggatttcctacaaggacagggaatggtgctttacaggcgagcggaataaccaaatcttagaggaaaatatggaggtcgaaatctggactcgagagggagagaaaaagaaactgagacccaagtggctcgatgcccgcgtatatgctgacccaatggccctgaaggatttcaaagagtttgctagcggcaggaagtctattacgcttgacatactgaccgagatcgcatcactccctacatacttgtccagtcgggccaaactggctctagataacattgtgatgctgcatactaccgaacgtgggggcagagcctaccagcacgcactcaatgagcttcccgaaagcctggagacattaatgttggttgcgctgctcggtgccatgaccgctggcatcttcctgtttttcatgcaggggaagggaattggcaaactttcgatgggtctgatggccatcgcagtggcttctgggctcttgtgggtcgccgaaatacagccacaatggatcgcagcctccattatcctggagtttttcagcatggctttactaattcctgagccggaaaagcagaggactccccaggacaaccagctgatctatgtgatactcacgattcttaccatcattggcctgatcgcggccaatgagatgggattgatagagaaaacaaagactgattttggcttctaccaagtcaagaccgagacaaccatcctggacgtggatctccgcccagcatcagcttggactctgtatgccgttgccacaacgattcttacccctatgctccggcatactatcgaaaacacaagtgcaaatctgtctttggctgccattgcgaaccaggctgccgtgctgatggggttaggaaaaggctggcccctacaccgaatggacctgggtgtaccactccttgcaatggggtgttactcccaggtgaatcctaccaccctgacagccagcttggtcatgctgtcagttcattatgctatcataggacccggcctccaggcaaaggccactagagaggcgcagaaaagaagtgctgccggtattatgaagaacccgacggtggatggcatcaccgtcatcgacctggagccaattagctacgaccctaaatttgaaaagcagcttgggcaagtgatgttactggcactctgcgccggacaattgctgctaatgcgcacaacttgggctttctgtgaggtactgaccctcgccacaggccccatccttaccctgtgggaagggaacccaggacggttctggaatactacgatacccgtgtccacagcaaacatttttagaggctcttatttggctggtgccgggctggcgttcagcctcatcaagaatgcccagacccctcgtaggggaactggcaccacaggtgagactctgggcgagaaatggaagcggcagttaaactcccttgatcgcaaagaatttgaggaatacaagcgatcagggattttcgaggttgacagacacgaaatcaaatacaccctgaaggatggatctaagataaatcacgcaatgagtacaggctcgatcaaaattagggggatcgacgagcggggaatggtgaagccgaaaggcaaggtcgtggatcagggttgcgggcgcggaggctggagccattatacggctaccgccaaaaaggtcactgaggtgaagggctacacaaaagggggacccggtcacgaagaaccaattcctatggcaacctatggctggaacctcgttaagctacattccggggtagacgtgttttacaaacccactgaacaagtcgatacactgttgtgtgacatcggagagtcttcaagcaatcctaccattgaagagggcagaacgctgagggtgctcaagatggttgagccatggctttccagtaaacccgagttctgcatcaaggtgctgaacccttatatgccaaccgtcatagaggaattggagaaactgcagcgaaagcacggtgggtctctcgtgcggtgtcccttaagccgtaattcaacacacgaaatgtactgggtatccggagtgagtggcaacattgttagctctgtcaatactacctccaagatgctgcttaacagatttacaactcgccataggaaaccgacctatgagaaggatgtggacctgggcgctgggacacggtcagtgagcatcgagaccgaaaaacctgatatgactatcattggaagacgcctacagaggctccgagaggaacacaaggagacgtggcattacgaccaggagaatccataccggacatgggcctatcacggttcgtacgaagccccctctaccggcagtgcgtccagcatggtcaacggggttgtgaaactgttgactaagccttgggacgtaataccaatggtgacccaactggctatgacagatacgacccccttcggacagcagagagagtttaaggaaaaagtctatacttcaacaccgcatcctaagccctggaccaggatggtgatgactacaaccgcaaattggctctgggcccttggcggtaaaaagaaatccccacgcctgtgcacatgggaggagttcatctctaaggttcgtagcaacgctgccattggggcagtgtttcaggaggagcaaggatggacaagtgcctccgaagctgtcaatgacagccggttctgggagttagtggataaggaaagagcgctgcaccaggagggcaaatgtgaatcttgcgtatacaacatgatgggcaagagggagaaaaagttgggggagtttggacgcgccaaaggttcacgagcaatctggtatatgtggctcggcgctcggttcctggagttcgaggccctagggtttcttaacgaagaccactggttcggaagagagaatagttggtccggcgttgaaggtgaggggctgcataggctcggatacattctggaggatatcgacaagaaggatggcgacttgatatatgcagatgacaccgccggctgggatacgcgcatcaccgaagacgatctgctcaacgaggaacttattacagagcagatggctcctcaccatagaatcctggccaaagcgatttttaagttaacttaccacagcaaagtgatgaaggtcctgcggcccaccccaaaaggggcagtgatggacatcatatctaggaaggaccaacgtggatcgggtcaggtgggcacatacgggttgaatactttcaccaacatggaggtccagctcattcgacagatggaagccgagggagttatcacgcaagatgacatgcagaatcccaaaggcctgaaggaacgcgtggagaagtggctaaaagaatgcggtgtagatagacttaagcggatggctatctcaggggacgattgtgtggtcaaacctctggacgagaggtttagcacatccctcctgttcttgaacgatatgggaaaggtgcgcaaagacattccacagtgggagccgagtaagggctggaagaattggcaggaagttcccttttgctctcaccatttccacaaaatatttatgaaggatggcaggagcttagtggtcccttgtcggaaccaagacgagctgatcgggagggcccgaatttcccagggagcaggttggtcactccgtgaaaccgcttgccttggcaaagcctatgctcagatgtggagtctgatgtacttccatagacgcgatctacggctggcctctatggcaatctgtagcgcggtgccaactgagtggtttcccacatccaggaccacttggtcaattcacgcccatcaccagtggatgaccacagaagacatgctcaaggtatggaatagagtttggatcgaggacaaccctaatatgacggataaaaccccagtgcacagctgggaggacgtcccctatttggggaagcgcgaagatctgtggtgcggatctcttataggcctgtccagtcgggctacttgggccaagaacatccatacagcaattacccaagtgaggaatctcatcggtaaagaggaatacgttgactatatgcctgtgatgaagcgatacagcgctccgattgagtcggaaggggtcttatga

SEQ ID NO: 15700 - RNA, 9867 nt, synthetic construct
  misc_feature 1..9867: note = derived and/or modified CDS sequence (opt3) from DENV-4__JQ922559__SS-prME
  source 1..9867: mol_type = other RNA
tcaaccatcacactgctctgccttattcccactgtgatggccttccacctgtccacgagagacggagaacctttgatgatagtcgctaagcatgaaagagggcggccattactgtttaaaaccacagaaggaatcaacaagtgtactctaattgcaatggatctcggtgaaatgtgcgaagacaccgttacatacaaatgtccgctgcttgtgaataccgaacccgaagatatcgactgctggtgtaacctgacttctgcctgggtaatgtatggcacatgcacccagtcaggggagcgccgacgtgaaaagagaagtgtggcgttgacgcctcacagcggaatgggcctcgagactagggctgaaacctggatgtcctctgagggtgcctggaaacatgcacaacgggtcgagtcgtggattctgcgcaatccagggttcgccctgctcgctggatttatggcatacatgatcggccagacaggcatacagagaactgtgttctttatcttaatgatgctggttgccccctcatatgggatgaggtgtgtgggagtcggtaaccgggatttcgtggaaggcgtaagcgggggagcttgggttgaccttgtgttggagcacggcggttgcgtcaccacaatggcccaggggaagcctaccctggattttgaactaattaagacgactgcgaaagaggtggcactcctgcgcacatactgtatcgaagccagtatttccaatatcaccactgctacacgatgcccaacccaaggagagccctatcttaaggaggaacaggaccagcagtacatatgtagaagggatgtggtcgaccggggctggggcaacgggtgcggactgttcggtaaaggcggggttgtgacgtgcgccaagtttttgtgttctggaaaaattaccggcaatctcgtacaaatcgagaacctggaatatacagtggtcgtgactgttcataatggtgatacccacgcagtggggaacgacattagcatccacggcgtcacagctactatcacccctcgttccccatcagtggaggtaaagttaccggattacggagaactgacactcgactgcgagccccgcagtggcattgacttcaatgagatgatacttatgaagatgaaaaagaaaacctggctggttcataagcagtggtttttggatctacctctgccatggactgccggggcggacacgagcgaagtgcagtggaactacaaagagagaatggtcacattcaaggtgccccacgccaaaaggcaggatgtcaccgtgctcggatctcaagaaggtgcaatgcattccgctctgactggcgccaccgaggttgactcaggggatggaaatcacatgtttgctggccaccttaagtgtaaggtgcggatggaaaaactgcgaatcaagggtatgagctatacaatgtgcagtgggaaattctctattgacaaggagatggccgagacccagcatggcactacagtagtcaaagtgaagtacgaaggagcaggcgccccttgtaaggttccaatcgagatacgcgatgtgaacaaagaaaaggtcgtggggagaattatctccagcacgcccttcgctgagaatacctattcggtaactaacatcgagttggaaccgccttttggagactcttacattatcattggtgtgggcgattccgcgctcacactgcactggttcaggaaagggtcaagtataggaaagatgtttgagagcacctatcggggcgcaaaacgcatggccatcttaggtgaaacagcttgggacttcgggtccgttggcggactgctaacttctctcggcaaggccgtccatcaggtgtttgggagcgtgtacaccacgatgttcggaggcgtctcatggatggttaggattctgatcggtcttttggtgctgtggatcgggaccaacagtaggaatacatccatggcaatgagctgcattgccgtgggaggcataactctctttctgggtttcaccgtacacgctgatatgggctgtgccgtctcttggtcagggaaggagcttaaatgcggaagtggcatctttgtgattgacaacgttcatacatggactgaacaatataagttccagcccgagagcccagcacgtctggcgtccgctatcttgaatgcccacaaagacggggtgtgtggcattcggtctaccacgcgactcgagaacgtcatgtggaagcagatcacaaatgaactgaactacgtgttatgggagggcggtcacgatctgaccatagttgcaggggacgtgaaaggagtactatcgaagggcaagagagccctcgctcctcccgtcaatgatctgaaatacagctggaagacttggggtaaagccaagatctttacaccagaaaccaggaactccactttccttattgacggccccgatacctcagagtgccctaatgaacgccgggcatggaactttttggaggtggaggactatgggttcggaatgttcacaacgaatatctggatgaaatttagagaaggcagttctgaggtgtgtgatcataggctgatgagcgctgccattaaggaccagaaagcggtccacgccgatatggggtactggatcgaatcctcaaagaaccaaacctggcagatagagaaggctagcctcattgaagttaaaacttgcctgtggccaaagacacataccttatggtctaatggagtgctggagtcccagatgcttatcccgaaagcatatgccggccccttcagtcagcacaactaccgccaaggttatgctacacagactgtagggccttggcacttgggaaagctcgagattgactttggcgaatgcccaggtaccacggtgacaatccaggaggattgtgaccatcgaggccccagcctgcggaccactaccgcctctgggaagctggtcacacagtggtgctgtcgttcctgcactatgcctccactgagattcctcggagaagatggctgttggtacgggatggagataaggcccctgtcagagcgcgaagagaatatggtgaagagtcaagttagcgcaggacagggcacctcggaaacattttccatgggtcttttgtgcctgacgttattcgtggaggaatgtctccggagaagggtcacccgaaagcacatgatcctggtggttgtgactacactttgcgcgattatcctagggggattgacctggatggacctcctgcgcgccctaattatgctgggcgacactatgtctagccggatgggcgggcagatccatctcgctataatggccgtctttaaaatgtcaccgggatatgtactgggtattttccttagaaagttgacaagtagggagaccgcactgatggtgatcggcatggctatgacgactgttttatccatccctcacgatctcatggagtttattgacgggatctctctgggacttattctgctaaaaatggtgacccatttcgataacacacagatgggcaccctcgccctgagcttgacttttataaagtccacaatgccactggtcatggcatggcgtaccatcatggccgtgttattcgtagtgacactcattcccctgtgtcgcacttcatgccttcaaaaacagagccactgggtcgaaatcaccgctctgattttgggtgcgcaggccctccctgtttacctgatgacgctaatgaagggggcaagtaagcggtcttggcccctgaacgagggaatcatggctgtgggccttgtgtccctcctgggcagcgccttgctgaaaaatgacgtcccattagccgggcctatggtggctggaggtctcctgcttgcagcctacgttatgtcgggctcatctgcggatctgagtttggaaaaggctgccaacgtacaatgggacgagatggcagatataacagggtccagccccatcattgaagtgaaacaggacgaggatggatcttttagcatcagagacgtcgaggaaaccaatatgattactctcctggtgaagctagccctgatcaccgtttccggcctttatccactcgctataccggtgacaatgactctgtggtacatgtggcaggtcaaaacccagaggtcaggtgcattgtgggatgtgcctagtcccgccgcggctcaaaaggccacgttaacagagggggtatatcgaattatgcagcggggactgttcggcaagacccaggtcggcgtggggatccacatggaaggagttttccatactatgtggcacgtgacacgcggtagcgtcatctgtcatgagtctggcagactcgaaccatcctgggcagacgtgaggaacgatatgatttcatacgggggaggctggcggctgggtgacaaatgggacaaggaggaggatgttcaggtgcttgccatagaacccgggaaaaatcctaagcacgtccaaaccaaaccaggactgtttaagactttgacaggcgagatcggcgctgtgaccctagacttcaaacccgggacgagtggaagccctattatcaaccgaaagggtaaggtaattggcctgtatgggaatggagtggttactaaatccggcgattacgtctctgccatcacccaggcagaaagaataggtgagccggactatgaggtggatgaagacatctttcgcaagaaaaggctcacaattatggatctgcatccaggggctggaaagaccaaacgtatccttccctcgattgtgcgggaggccttaaagagaaggctgcgcacactcatcttggcgcctactcgagtcgtagccgcagaaatggaggaagctctgagaggcctcccaatacggtaccagacccccgccgtgctgagcgagcacacgggcagggagattgttgaccttatgtgccacgctacattcactacccgcctgttgtcatccacacgtgtgcctaactacaatctaatcgtcatggatgaagcacattttaccgacccgagttctgtggccgccagagggtatatcagcactcgggttgagatgggagaagctgcggcaattttcatgaccgccacacccccaggtacgactgatccttttccccagtccaactcaccaatcgaggacatagaaagggagattcctgagcgctcttggaataccggcttcgactggatcacagattaccaagggaagaccgtgtggtttgtccccagcattaaagctggaaacgacatcgccaattgcctgcgaaagagtggcaaaaaggtgatacagctctccagaaaaactttcgatacagaatatccaaagaccaagttaacggactgggattttgtagtgactacagacattagcgttatgggtgcaaacttccgggccgggagggtcatcgatccgcgcagatgtctgaaacctgtgatcattaccgacggccccgagagggtgatccttgctggaccaattcccgtcacccctgcgtctgccgcacagcggcgtggccgcatagggcgaaatccagctcaagaagatgaccagtacgttttctcaggagatcccctgagaaacgacgaggatcacgcccattggactgaagcaaagatgctcttggacaacatctatacacctgagggtattatcccgaccctgtttggcccagagagggaaaagactcaggccatcgacggggagttccggctccgcggagaacagagaaagacttttgtggagctgatgaggcggggcgatcttcccgtatggctatcctacaaagtggctagtgccggtattagctataaggaccgagagtggtgcttcacgggggaaagaaataaccaaatactggaggaaaatatggaggtcgaaatctggacccgcgagggcgagaagaaaaagttgaggcctaaatggttagatgcgcgggtgtacgcagaccccatggccctgaaggattttaaagagttcgcttcgggacgtaagtctattacactcgacatcctgactgagattgcctcccttccaacctacctgagctcaagagctaagctcgcattggataacatcgttatgctgcacacaaccgaaaggggcgggaaagcctatcagcacgctctaaatgagctgcctgaaagtctcgagactcttatgctggtggccttattgggagcaatgacggcgggtatatttctgttctttatgcagggcaaggggatcggagagctctctatgggcctgattgccatcgctggtgcctccgggcttctgtggggcaccaaaacacccccaccttggggagcagctagcaacattctcgagttctttttgatggtcctgttaatcccggagcccgaaaagcagcgcactccacaagacaatcagctaatatacgtaattctgaccatcctcacaattatcggccttgtggccgcaaacgagatggggctgatagagaaaaccaagactgatttcggattttatcaggttaaaacagagacgaccatcttggacgtggatctgcggcctgcctcagcttggactctctacgcggtcgccacaaccattctgacccccatgcttcgacatacaatcgagaatacaagtgcaaacctcagcctggctgccattgccaatcaggcagctgtgttgatgggcctgggtaaggggtggccattacacagaatggacctaggagtccctctgctcgccatgggctgttattcccaagtgaaccccacgacccttatcgcgtctctggttatgttgctggtgcattacgctataattggtccgggcctccaggccaaggcaacaagggaagcccagaaacgcactgctgcagggatcatgaagaatccaaccgtagatggaatcacagtgattgacctggagcctatcagctatgaccccaaattcgaaaagcagcttggccaagtcatgttactggttctctgcgccgggcagttgctgctaatgcggaccacttgggcgttctgtgaggtgctgacgctcgctacaggaccaatacttaccctgtgggagggcaaccccggtagattttggaatactaccattgccgtctccacagcaaacatcttccgtgggtcatacttggccggagctggcctggccttttctctcattaaaaacgcacagactcctaggcggggtaccggcgtgacaggggaaacgctgggagagaagtggaagcgccaattaaatagtcttgatcgaaaagagttcgaggaatacaagagatcgggcatcctggaggtagacaggaccgaggctaaaagcgccctcaaggatgggtccaaaataaagcaggcggtgtctcggggaacttcaaagatccgctggattgttgaaagaggcatggtgaaaccgaagggtaaagtcgtggacctagggtgcggaaggggcggctggagctattacatggccacactgaagaacgtcaccgaggtgaaagggtatactaagggaggtcccggccacgaagaaccaatccctatggcaacatacgggtggaatttggttaagctgcattcccgagtagatgtgttttataaacccaccgaacaggtcgacacgctcctttgtgatattggagagagttctagcaaccctaccatcgaggaaggccggacactgcgtgtgttgaagatggttgagccatggctgtcatccaaacccgagttctgcattaaggtgctcaatccttacatgccaactgtcatcgaggaattagagaaactgcagagaaagcacggtgggagtcttgtgcgctgtcccctgagcaggaactctacccacgagatgtattgggtatccggagtgtcaggcaatatagttagctcggtcaacacaacttctaaaatgctactcaatcggtttaccacaaagcatagaaagccgacctacgaaaaagacgctgatctgggcgccgggactcgcagtgtgtccacggagacagaaaagcctgacatgaccattatcggaaggcgattgcaacggctgcaggaggagcaccaggaaacttggcattacgatcaggagaacccatatagaacctgggcataccacggtggctatgaagctcccagcacagggtcagcctcctctatggtgaatggagtcgttaaactccttacgaagccttgggacgtgatcccaatggtaacccaactggccatgactgacacaacccccttcggccagcagagggtgtttaaagagaaggtcgatactcgcacaccgcagcctaagcccggtacccgtatggtgatgacaactaccgcgaactggttatgggctctgttggggaaaaagaaaaatccacggctctgcacgagagaagagttcattagcaaggttaggagtaacgcagccataggagctgtgtcccaagaggaacagggctggaccagctcttttgaggccgtcaatgactcacgcttctgggaactggtggataaagagcgagcactacaccaggaaggcaagtgtgagagttgcgtatacaacatgatggggaagcgggagaagaaacttggagaatttggtagagccaaaggctccagggctatctggtatatgtggctgggggcgcgcttcctcgagttcgaagccctgggatttttgaatgaggaccattggttcggcagagaaaacagctggtctggtgttgagggggagggactgcaccggctcggctacattcttgaagatctggacaaaagggatcgttcgttagtgtttgcagacgatacagctggctgggacactaaaatccctgaggatgacctgttgaaggaaaagcccattccagggcccatggcccctcatcaacgaatcccagcacgcgccatattcaaactcacctatcagaacaaggtcgtgaaagtgctgagactaaaacttaaaggagctgtcatggatatcatttcacggaaggagcagaggggtagcggccaggttgggacatacggactgaatacttttaccaacatggaggtgcaactcatccgccagatggaagccgagggcgtaattacgagagacgacatgcacaatccgaaaggtctgaaggaacgggtggagaagtggttgaaagaatgcggggtcgataggttagagcgaatggcgatctccggagacgattgtgtggttaagcccctggacgagcgtttcagtacatctctcctttttctgaacgatatgggcaaagtgagaaaggacatacctcagtgggaaccaagcaaaggctggaagaattggcaggaggtccccttctgctcccatcactttcacaagattttcatgaaagatgggcgcagcctagtggtaccttgtcggaaccaagacgaactgatcggaagggcaagaatcagtcagggtgccggctggtctctccgcgagaccgcttgcttggggaaggcctacgcacagatgtggagcctgatgtattttcatcggagggatcttcgactggcttccatggccatttgttcagctgttccaactgaatggttccccacaagcagaaccacttggtctatacacgcccatcaccagtggatgaccacagaggacatgctcaaagtgtggaatcgggtctggatcgaggataaccctaatatgacggacaagaccccggtgcactcctgggaagacattccatacttaggaaaaagggaggatctgtggtgcggcagtttgatcggtctgagctcgcgcgcaacttgggcgaagaacattcatacagccatcacccaagttcgtaatctcatagggatcgaaggatatgtggactactttcttctgattaagtggtattccgctcccttcgagtctgaaggcgtcctatga

SEQ ID NO: 15701 - RNA, 9867 nt, synthetic construct
  misc_feature 1..9867: note = derived and/or modified CDS sequence (opt3) from DENV-4__KF955510__SS-prME
  source 1..9867: mol_type = other RNA
agcaccatcactctgctctgccttattcccactgtgatggccttccacctgtccacgagagacggagagcctttgatgatagtcgctaagcatgaaagggggcggccattactgtttaaaaccacggagggaatcaacaagtgtactctgattgctatggatctcggtgaaatgtgcgaggacaccgttacctacaaatgtccgctgcttgtgaataccgaacccgaggatatcgactgctggtgtaacctgacttctgcctgggtgatgtatggaacatgcacccagtcaggggagcgccgacgtgaaaagaggagtgtggcgttgacgcctcacagcggaatgggcctcgagactaggaccgaaacatggatgtcctctgagggtgcttggaaacatgcccaacgggtcgagtcgtggattctgcgcaagccagggttcgcgctgtcagccggatttatggcttacatgatcggccagactggcatacagaggaccgtgttctttatcctcatgatgttagttgcacccagctatgggatgaggtgtgtgggagtcggtaatcgggatttcgtggaaggcgtaagtgggggagcctgggttgacctggtgcttgagcacggcggttgcgtcacaaccatggctcaggggaagcctacgttggattttgaactgattaaaactacagccaaggaggtggcgctactccgcacctactgtatcgaagcatccatttctaacatcactacagccacccgatgcccaacgcaaggagagccctatctgaaagaggaacaggaccagcagtacatatgtagaagggatatggtggaccggggctggggcaatgggtgcggacttttcggtaagggcggggtcgttacctgcgctaaatttagctgttccggaaagattacaggcaacctggtgcaaatcgagaatttggaatatactgtagtggtcaccgtgcataacggtgatacacacgccgttgggaatgacacttcaaaccacggcgagaccgcaacaattacccctcgtagtccaagcgtggaagtccgcctcccggattacggagagctgactttagactgcgagcccagatctggcatcgacttcaatgaaatgatcctgatgaagatgaaaacgaagacatggctcgtgcataaacagtggtttcttgatctgcctttgccatggaccgctggggccgacacttccgaggtacactggaaccataaggaaaggatggttaccttcaaagtgccccacgcgaagcggcaggatgtcacagtgctaggatcacaggagggtgccatgcacagcgcactggctggcgccaccgaagtcgacagtggggatggaaatcatatgtttgctggccacctcaaatgtaaggtgcgaatggagaagctgcgcattaaaggtatgtcttacactatgtgctccgggaagttcagcatagacaaagagatggccgaaacacaacatggcacgaccgttgtgaaggtaaaatatgagggaactggcgcaccttgtaaggtcccaatcgaaattagagatgtgaacaaggagaaagttgtggggaggatcatatcgtctacacccttcgccgagaataccaactccgtcacaaacattgaacttgagccgccttttggagactcatacatcgtgatcggtgctggcgatagtgcgctgactttgcactggttccggaaggggagctccattggaaaaatgtttgaatctacctatcgcggcgcaaagagaatggccatcctcggtgagacggcttgggacttcgggagcgtaggcggactgttaacctcactgggcaaagccgtgcatcaggtttttgggagtgtctacacaactatgttcggaggcgtgtcctggatggtgaggattctaataggtctcctggtcctttggatcgggaccaatagccgtaacacatctatggcaatgtcatgcattgttgtgggaggcatcactttgtttctgggtttcaccgtgcacgccgatatgggctgtgtagtcagttggagcgggaaggaactcaagtgcggatccggcatctttgtgattgacaatgttcacacgtggacagagcagtataaattccaacccgagtctccagctcggctggcctcggcaatacttaacgcgcataaggacggggtgtgtggaatccgaagcaccactagactggaaaatgtcatgtggaaacagattacaaacgagttgaattacgtgctctgggaaggcggtcacgatctgaccgttgtggctggggacgtaaagggagtcttatccaaaggcaagagggccctggcacctcccgtgaacgatctaaagtattcatggaaaacttggggtaaggccaaaatctttaccccagagacacgcaatagtacgttcctcgtggacggccccgatacctctgaatgccctaacgagcggagagcttggaattttctggaggtcgaagactacgggttcggaatgttcactacaaacatttggatgaagtttagggagggcagctccgaagtttgtgatcatcgccttatgtcagccgcaatcaaagaccagaaggctgtgcacgccgatatggggtactggatagagagctctaaaaatcagacctggcaaatcgaaaaggcgtccttgattgaggtaaagacatgcctgtggccaaaaactcacaccctctggagtaacggagtgctggagagccagatgttaatcccgaaggcctatgctggccccatttctcagcataattaccgacagggttatgcaacgcaaacagtcgggccttggcacctgggaaaacttgaaatcgacttcggcgagtgcccaggtaccactgtgaccatacaggaagattgtgaccatcggggcccctccttgcgtacaactaccgcctcagggaagctcgttacacagtggtgctgtagaagttgcacgatgcctccactgaggtttctaggagaggatggctgttggtacgggatggagattcgccccctgaacgaaaaagaggaaaacatggtaaagagccaggtctcggctggacaaggcacctccgagactttctctatgggtctcctgtgccttacattgtttgtggaagagtgtctgcggagaagggttacccgaaagcacatgatcttagtggtcgtaactacactctgcgccattatcctaggcgggcttacctggatggacctgttgcgcgcactcataatgctgggggacacgatgagcggccggatgggaggacagatccatctagcgattatggccatgttcaaaatgtcaccgggttatgtgctgggcatctttctcagaaagctgacaagtagggagaccgctcttatggttattgggatggccatgacaaccgtgttgtccatccctcacgatctgatggagttcatagacggaatttctttaggcctcatcctgcttaaaatggtcactcactttgataatacacaggtgggtaccctggcactaagcctcacattcatcaagtccactatgccactggtaatggcttggcgtaccattatggccgtgttgtttgtcgttacgctgatccccttatgtcgcacatcatgcctccagaaacaaagccattgggtggagattaccgcactgatacttggggcccaggctctgcctgtgtacttgatgactctcatgaagggagcgagtaagcggtcttggcccctgaacgaaggcatcatggccgtcggcctagtgtccctgcttgggagcgcactcctgaaaaatgacgttccattggctggacctatggtagccggtggcctgttactcgccgcttatgtgatgtcggggtcatctgcagatctgagtcttgagaaggccgcgaacgtccagtgggacgaaatggctgatattaccggatccagccccatcattgaggtgaaacaagacgaggatggctctttcagcatcagagacgttgaagagacaaatatgataactctgttggtgaagctcgccctgatcaccgtctccggtctatacccactggcaattccggtgacgatgacactttggtacatgtggcaggtaaaaacccagaggtcaggggccctctgggatgtccctagtcccgctgcagcccagaaggcgactctgacagaaggagcttatcgaatcatgcaacggggcttgtttggcaagacccaggtgggggttggcattcacatggagggtgtgttccatactatgtggcacgtcacacgcggcagcgtgatctgtcatgaatctgggagattagagccatcctgggccgacgttaggaacgatatgatatcatacggaggcggttggcggctgggggacaaatgggacaaggaggaagatgtgcaggtcctcgcaattgagcccggcaaaaatcctaagcacgtgcagaccaaaccaggcctgttcaagacgcttactggcgaaatcggggccgtaaccctggactttaaacccggaacaagtggtagccctatcattaaccgaaagggcaaggtgatagggttgtatggaaatggcgttgtcaccaaatccggtgattacgtgtctgctatcacacaagccgagagaattggggagccggactatgaagtggatgaggacatcttccgcaagaaaaggctaactattatggatctgcacccaggagcaggcaagaccaaacgtatcctcccctcgatagtccgggaagctctgaagagaaggcttcgcacgttaatcctggcccctacacgagtagtggcggccgagatggaagaggcactcagaggcttgccaattcggtaccagactcccgctgttaagagcgagcataccgggagggaaatcgtggacctgatgtgccacgccacatttaccactcgcctcctgtcatccacccgtgtccctaactataatcttattgtgatggatgaggctcatttcacagacccgagttctgttgcagccagaggatacatcagcacgcgggtggaaatgggtgaggccgctgcgatatttatgactgcaacacccccaggcacaaccgatcctttcccccagtccaactcaccaattgaagacatcgagagggagatccctgaacgctcttggaatactgggtttgactggattacagattaccagggaaaaaccgtctggttcgtgcccagcatcaaggccggcaacgacatagctaattgcctgcgaaaaagtggtaagaaagtaattcaattgtccagaaagacgtttgatactgagtatccaaagacaaaactaaccgactgggatttcgtggttaccactgacatcagcgaaatgggggccaactttcgggcaggcagggtcattgatccgcgcagatgtctgaagcctgtgatcctcacagacggacccgagagggtgatattagccggcccaattcccgtcacccctgcttctgcggcccagcggcgtgggcgcatcggacgaaacccagcacaggaagatgaccaatacgttttctcaggtgatcccctgagaaatgacgaggatcacgctcactggacagaggccaaaatgcttctggacaacatctatactcctgaaggcattatcccgacactcttcgggccagagagggaaaagacccaggcaattgacggagagtttcggttgcgcggcgagcagagaaaaacattcgtggaactgatgaggcggggtgatctccccgtatggctgtcctacaaggtggccagtgctgggataagctataaggaccgagagtggtgctttactggcgaaagaaataaccagatccttgaggaaaatatggaggtcgagatttggacccgcgaaggagagaaaaagaaactaaggcctaagtggctggatgcccgggtgtacgcggaccccatggcattgaaagatttcaaggaatttgcctcgggccgtaagtctatcacattagacatcctgaccgagattgcttccctcccaacttatctgagctcaagagccaaacttgctctggataacatagttatgctccatacgaccgaaagagggggaaaggcataccaacacgccttgaatgagctgcctgagagtctagaaacactgatgctcgtggcacttctgggtgccatgactgcaggcatcttcttatttttcatgcaggggaaaggaatgggcaagttgtctatgggtctgattgcgatcgccgtcgcttccgggctcctgtgggtagccgagattcagccccagtggatcgcagctagcataatccttgaatttttcctgatggtgctcttggttccagagcctgaaaaacaacgcaccccgcaggacaaccagctgatttacgtgatcttaacaattctaaccatcatagccctggtcgcagccaatgagatgggcctcattgagaagactaaaacagattttggattctatcaggctaagacggaaaccactatccttgacgtggatctgcggcccgcgtcagcctggacattgtacgcagtcgctaccaccattctgacaccaatgctccgacatactatcgagaacacgagtgccaatctgagccttgccgcaatagctaaccaagccgcggtgctcatgggcctggggaagggatggcctttgcacagaatggacctgggcgttcccttactagctatgggttgttattcccaggtgaatccaaccacactgactgcctctctcgtaatgcttctggtgcattacgcaatcattgggcctggattgcaggccaaagctaccagggaagcacagaagcgcacagccgcgggcatcatgaaaaaccccaccgtcgatggtattactgttatcgacctggagccgataagctatgacccaaagtttgagaaacaactcggccaggtgatgctgcttgtcttatgcgctgggcagctgctcttgatgcggacgacatgggccttctgtgaagtgctgaccctagcaactggacctattctgaccctctgggagggcaatcccgggagattctggaacacaactatcgccgtatccaccgctaacatctttcgtggatcataccttgccggcgcaggtctggctttctctttgattaagaatgcccaaacaccaaggcgggggacgggaaccactggcgaaacactgggtgagaagtggaaacgccagctcaacagtctggatcgaaagggctttgaagagtataaaagatcggggatcttagaggtggacaggaccgaagcaaagagcgcccttaaagatggatccaagataaagtacgcagtttctcggggcacttcaaaaattcgctggatcgtggagagagggatggtcaagcccaaaggaaaggtggtcgacctgggctgcggtagagggggatggagctactatatggctacactcaaaaatgtgaccgaagttaagggctacacgaagggcgggcctggacacgaggaaccgattcccatggccacctatggttggaacctagtaaaactgcactccggcgtggatgtcttctacaagccaacagaacaggtggacactttgctgtgtgatatcggggagagttctagcaatcctaccatagaagagggacgaacactccgggttcttaaaatggtggaaccctggctgtcatccaagcctgagttttgcatcaaagtcttgaacccatatatgcccactgtgattgaagaactggagaagctccagcgtaaacatggcggtagtttagtaagatgtcctctgagccgcaattctacccacgaaatgtactgggtgtccggggtttcaggaaacatcgtcagctcggtgaatacaacctctaagatgcttctgaacaggttcactacgcggcatagaaagccaacatatgagaaagacgcagatctaggcgctggcacccgcagtgtgtccactgaaaccgagaagcccgacatgacaattatcgggaggcgactccaacggctgcaggaggaacacaaagagacgtggcactacgatcatgaaaatccgtacagaacctgggcctatcacggaagctacgaggccccttcaactggttccgcgtctagcatggtcaacggcgttgtgaagttgctgacaaaaccatgggacgtagtgcccatggtcacccagctcgctatgactgacacaaccccttttgggcagcaaagggtgttcaaggaaaaggttgatacacgcactccacagcccaaaccgggaacccgtgtggtcatgacgaccacagcaaattggctttgggccctgttaggccggaagaaaaaccctagactgtgcactagggaggagtttattagtaaggtgcgctccaatgctgccatcggtgcagtattccaggaagaacaggggtggaccagcgcctctgaagctgttaacgactcacgattttgggagttggtggataaagaacgggcgctccatcaagagggaaagtgtgagagttgcgtctataatatgatgggcaagagagagaaaaagctgggcgagttcgggagggccaaaggatcccgcgcaatatggtacatgtggctaggtgctagatttcttgagttcgaggccctgggcttcctcaacgaagaccactggtttgggcgggagaacagctggtctggagtggagggcgaaggtctgcataggttggggtatattctggaggatatcgacaagaaagatggagacctcatctacgcagatgacacagccggctgggatactcgtattaccgaagacgatcttctgaatgaggagttaataacggaacagatggctccccaccacaagatcctggccaaggcgattttcaaattgacatatcagaacaaggtggtcaaagttctccgaccaacccctaagggcgcagtgatggacatcatttcgcgcaaagaccaaagagggtcaggacaggtaggtacttacggcctgaatacatttaccaacatggaggtgcagctaatccggcagatggaagccgagggggtcataactagggatgacatgcataatcccaagggacttaaagaacgcgtggagaagtggctgaaggagtgcggcgttgatagactcaaacggatggctatcagcggtgacgattgtgtggtcaagccactggacgaaaggttctccaccagtttgttatttctgaacgatatggggaaagtgcgaaaggacattccccaatgggagccttctaaaggatggaagaattggcaggaagtaccattctgcagccaccattttcacaagatcttcatgaaagatggccgttccctcgttgtgccgtgtagaaaccaggacgagcttattggccgcgcccggatctcacagggggcaggatggagtctgagggaaacagcttgcctaggtaaggcctacgctcaaatgtggtctctgatgtattttcacagacgcgatctccggttggccagcatggcaatatgttccgcggtccccacggagtggttccctacctcaaggactacatggagcattcatgcccaccatcagtggatgaccactgaggacatgctgaaagtgtggaatcgagtttggatcgaagacaacccaaatatgatcgataagacacccgtgcactcttgggaggacattccttaccttggcaaaagagaagatctgtggtgcgggtccctcataggattaagtagccgggctacctgggccaagaacatccatacggcaattacacaggtcaggaatctgatcggcaaggaggaatatgtggactacatgccagtaatgaaacgctattcggctcactttgagtccgagggtgtgttgtga

SEQ ID NO: 15702 - RNA, 9867 nt, synthetic construct
  misc_feature 1..9867: note = derived and/or modified CDS sequence (opt3) from DENV-4__GQ868594__SS-prME
  source 1..9867: mol_type = other RNA
agcaccatgacactgctctgccttatccccactgtgatggccttccacctgtccacgagagacggcgagcctttgatgattgtcgctaagcatgaaagggggcggccattactgtttaaaaccacagagggaataaacaagtgtactctaatcgcaatggatctcggtgaaatgtgcgaggacaccgttacatacgaatgtccgctgcttgtgaataccgagcccgaggatattgactgctggtgtaacctgacttctgcctgggtaatgtatggcacatgcacccagtcaggggaacgccgacgtgagaaaagaagtgtggcgttgacgcctcacagcggaatgggcctcgaaactagggctgagacctggatgtcctctgagggtgcctggaagcatgcacaacgggtcgaatcgtggatcctgcgcaatccagggttcgccctgctcgctggatttatggcatacatgattggccagacaggcatccagagaactgtgttctttgttttaatgatgctggtggccccctcatatgggatgaggtgtgtcggagtgggtaaccgggatttcgtagagggcgttagcgggggagcttgggtggaccttgtcttggaacacggcggttgcgtgaccacaatggcccaggggaaacctaccctggattttgagctaataaagacgactgcgaaggaagtggcactcctgcgcacatactgtatcgaggccagtatttccaatatcaccactgctacacgatgcccaacccaaggagagccctatcttaaagaagagcaggaccagcagtacatttgtagaagggatgtcgttgaccggggctggggcaacgggtgcggactgttcggtaagggcggggtggtaacgtgcgccaaattttcttgtagcggaaagatcaccggcaatttggtgcaaatagaaaacctcgagtatacagtcgtggttactgtgcataatggtgatacccacgcagtcgggaacgacattcctaatcacggcgtgacagctactatcaccccacgttccccgtcagtagaagttaaactgcccgattacggagagttaacactggactgcgagcctcgcagtggcattgacttcaacgaaatgatcctcatgaagatgaagaaaaagacctggcttgtgcataaacagtggtttctggatttgccactaccctgggccgcgggggccgacactagcgaggtccactggaattacaaggaaagaatggtgacgttcaaagtccctcatgcaaagaggcaggatgtgatcgttctgggatctcaggagggtgctatgcactccgccctcacaggcgctaccgaagtggactcaggggatggaaaccacatgtttgccggccatctgaaatgtaaggtacggatggagaagcttcgaattaaaggtatgagctatactatgtgcagtgggaagttctctatagacaaagagatggcagaaacccaacacggcacaaccgtcgtgaaggttaaatacgagggagccggcgctccatgtaaggtgcccatcgaaattcgcgatgtcaataaggagaaagtggtagggagaatcatatccagcactccgttcgcggagtatacaaactcggtgacgaacattgaactggagcctccctttggagactcttacatcgttatcggtgtcggcgattccgcattgaccctccattggttcaggaaggggtcaagtattggaaaaatgctggaaagcacttatcggggcgccaagcgcatggctatcttaggtgagacagcctgggactttgggtccgtgggcggactgctaacctctctcggcaaagcagtgcaccaggtcttcgggagcgtttacacaactatgtttggaggcgtgtcatggatggtgagaattctgataggtttccttgtattgtggatcgggaccaatagtaggaacacgtccatggccatgacctgcattgctgtcggaggcatcacactgtttctcggtttcactgtgcatgccgataccggctgtgcagttagctggtctgggaaggaactgaagtgcggatcaggcatctttgtgattgacaatgtccacacatggactgagcagtataaattccaaccagagagtcctgcgcgtcttgctagcgccatactgaacgcacacaaggacggggtgtgtggaatccggtccaccacgcgattggaaaatattatgtggaaacagatcacaaacgagctcaattacgttctgtgggaaggcggtcatgatttaaccgtggtagccggggacgtcaagggagtgctgtctaaaggcaagagagctctagcccccccagtgaacgatctcaagtactcgtggaaaacttggggtaaggcaaaaatttttacacccgaggctaagaatagcaccttcctgatcgacggccctgatacttccgaatgcccaaacgagaggcgcgcctggaattttcttgaggtcgaagactatgggttcggaatgttcaccacaaacatatggatgaaatttcgggagggctcaagtgaagtttgtgatcacagattgatgtctgcggccatcaaggaccagaaagctgtgcatgcagatatggggtactggattgagagctccaagaatcagacgtggcaaatcgaaaaggcctcactgattgaggtaaaaacctgcctctggccgaagactcacacactgtggagcaacggagtgttagagtctcagatgctgatccccaaagcttatgccggccctttctcccagcacaattacaggcagggttatgcaacccaaacagtcgggccatggcatcttggaaagttggaaatagactttggcgagtgccccggtactaccgtgacgattcaggaagattgtgaccaccgcggccctagtctccgaacaaccactgcgagcgggaaactggttacccagtggtgctgtcggtcttgcacaatgccacccctacgtttcctgggagaggatggctgttggtacgggatggagatcagaccgctctccgaaaaggaggaaaacatggtgaagtcacaggtcagtgccggacaaggcactagcgagaccttttcgatgggtctgctttgcttgacactgttcgtggaagagtgtttaaggcgccgggttacgagaaaacatatgattctcgtggtcgtaaccactctgtgcgctatcatacttgggggactgacatggatggacttgctcagggccctgatcatgctaggcgacaccatgtccggccgaatggggggacagattcacctggcaatcatggctgtgtttaagatgtctcctggttatgttctcggcattttcctgcgcaaacttactagccgggagacagccttgatggtgatcgggatggcaatgaccacggtcctgtcaataccacatgatttaatggaatttattgacggaatcagtctcggcctgatccttctgaagatggtgactcacttcgataacacccaggtaggtacactagccctctccctgacctttattagatctactatgcccttggtgatggcttggaggacaatcatggcggtcctgttcgttgtgaccttaattcctctctgtcgtacaagctgcctgcagaaacaatcccactgggtggagataactgcccttatcctgggggcacaggctttgcccgtctacctcatgaccctgatgaagggagcctcaaagcgcagctggccactaaatgaaggcattatggccgtgggcctggttagtcttctcgggtctgctctgttgaaaaacgacgtacctctggcaggacccatggtggccggtggcttactcctggcggcttacgtcatgtccgggagctcggccgatctttcactggagaaggcagccaatgtgcagtgggacgaaatggctgatatcacgggatctagtccaattatcgaggttaaacaagacgaggatggctcctttagcatacgggacatcgaagagacaaacatgattaccttgctcgtgaagctggcactaatcactgtctctggtctgtatccgcttgccattcctgtgaccatgacactctggtacatgtggcaggtaaaaactcagagaagcggggcgctgtgggatgtcccctccccagctgccgcacagaaggccaccttgacggaaggagtgtataggatcatgcaacgaggcttattcggcaagacacaggttggggtgggaatacatatggagggtgtcttccacaccatgtggcatgtgactcggggctcagttatttgtcacgaaacagggcgcctggagcccagttgggctgacgtgagaaatgatatgatcagctacggaggcggttggaggctcggggacaaatgggacaaggaggaagatgtccaggtgctggccatcgagcctggaaaaaacccaaagcatgtacagaccaaacccggcctttttaagactctgacaggcgaaattggggcagtgaccttggacttcaaacctggaacgtctggttccccgataatcaatcggaagggcaaggttattgggctatatggaaacggcgtcgtgactaaatcaggtgattacgtgagtgctatcacccaagccgagcgaacaggggagccagactatgaagtcgatgaggacatttttagaaagaaacgcctgaccatcatggatctccaccccggagcgggcaagacaaaaaggatactgcctagcatcgtacgtgaagcccttaagcggagattaaggactctgattctcgcaccaacccgcgtggttgctgccgagatggaagaggctttgcgaggcctgcccatcagataccagacgcctgcagtgaagtccgagcacacagggcgggaaattgtcgacctcatgtgccatgccactttcaccacaaggctgctttcttcgacccgcgtgccgaattacaacctgatcgttatggatgaggcccactttactgaccccagctcagtggctgcgcgtggatatatatccaccagagtcgaaatgggtgaggcagccgctattttcatgacagccacgccacctggcgcaactgatccctttccacagagtaattctcctatcgaagacatcgagcgggagattcccgaaaggagctggaacaccgggttcgactggatcacagattaccagggaaaaaccgtgtggtttgtaccatccataaaggccggcaatgacattgctaactgcttgcgcaaatcaggtaagaaagtgatccaactatctcgaaagactttcgatacagagtatccgaagaccaaactgacggactgggattttgttgtcactacagacattagcgaaatgggggcgaatttcagagccggccgggtgatcgatcctaggcgctgtctcaagcccgtgataagtaccgacggaccagagagagtcattttagcaggccccatccctgttaccccagcttccgccgcacagaggcgggggcgtatcggacgcaaccccgcccaggaagatgaccaatacgtgttcagcggtgatcctctgaaaaacgacgaggatcatgctcactggactgaggccaagatgcttctggacaatatttatacaccggaaggcatcattccaaccctctttgggcccgagcgagaaaaaaaccaggcgatagacggagagttcagattgaggggcgagcagcggaagacatttgtagaactgatgcgcagaggtgatctccctgtgtggctgtcttacaaggtcgcatcagccgggatctcctataaagacagggagtggtgcttcactggcgaacggaataaccagattcttgaggaaaatatggaggtggagatctggacgcgagaaggagagaagaaaaagctaagacccaaatggctggatgctcgcgtttacgccgacccaatggctttgaaggattttaaggaattcgcaagtggcaggaaaagcatcaccttagacattctgacagagatagcctcgctccctacttacctgtcttcccgggctaagcttgccctggataacatcgtgatgctccacaccacagaacgtgggggaaaagcatatcaacatgcgttgaatgagctgcccgagagcctagaaaccctgatgctcgtcgcccttctgggtgctatgactgccggcatttttttattctttatgcaggggaagggaatcggcaaattgtcaatgggtctgattgcaatcgctgtagccagtgggctcctgtgggtggcagagatacagccacagtggatcgccgcttctattatccttgaattctttctgatggttctcttgattcctgagccggaaaagcaaagaacgccccaggacaaccagctgatctacgtgatattaaccattctaacaatcattggcctgatcgcggccaatgagatgggactcatagagaaaactaagaccgatttcggcttttatcaggtcaagacagaaaccactatccttgacgtggatctgaggccagcatccgcttggacattgtacgccgtcgccacgaccattctgactcctatgctccgccacacaatcgagaacaccagcgcaaatctgtcacttgctgccattgcgaaccaagctgccgtgctcatggggctgggaaaaggctggcccttgcatcggatggacctgggtgttccattactagcaatggggtgttatagtcaggtgaatcctaccacactgatcgccagcctcgtaatgcttctggtgcactacgctataattggacccggcttgcaggcaaaggccactcgagaagcgcagaaaagaacggctgccggtatcatgaagaacccgaccgtcgatggcatcacagttattgacctggagccaatctcctatgaccctaaattcgagaagcaactcgggcaggtgatgctgcttgtcttatgcgcaggacagctgctcttgatgaggactacctgggccttctgtgaagtgctgacactagctaccggccccgtactgactctctgggaggggaatccaggacgcttttggaacacgacaatagccgtgtctaccgcaaacattttccggggcagctaccttgctggtgccgggctggcgttttccttgatcaagaatgcccaaactcccagacgtggaaccggcacaactggtgaaaccctgggcgagaaatggaagaggcagctcaactcactggatcggaaagaattcgaggagtacaagcgctctgggattttagaagttgaccgaacagaggcaaaaagtgctcttaaggatggatcgaagatcaaacatgccgtgagcagaggctcctctaagataaggtggatcgtcgaacgggggatggtgaaacctaagggaaaagtcgtggacctgggctgcggtcgcgggggatggtcatattacatggcaacgctcaagaatgttaccgaggtaaagggctatactaaaggcgggccgggacacgaagagcccattccaatggctacatacggttggaacctagtgaagctgcacagcggcgtcgatgtgttttataaacctaccgagcaggttgacactttgctgtgtgatatcggggaatccagttctaatcccacaattgaggaaggaagaaccctcagggtgcttaagatggtcgagccttggctgagctcaaaaccagaattctgcatcaaggtgttgaacccctacatgcctacggtaattgaggagctggaaaaactccagcgaaagcatggcggttccttagtgcggtgtccactgagtcgtaatagcacccacgagatgtattgggtttctggggtctccggaaacatcgtgtcaagcgtgaatacaacttcgaagatgcttctgaacagatttaccacacgccataggaaacccacttacgaaaaggacgtcgatctaggcgccggcacccggtctgttagtacagagaccgagaaaccggacatgactataattgggagacgcctccaaaggctgcaggaagagcacaaggaaacgtggcactacgatcaggagaatccttatcgaacatgggcctaccatggatcctatgaagcgccaagcaccggttcagcttcctctatggtgaacggcgtagtgaaattgctgactaagccctgggacgtcatccctatggtgacccagctcgcaatgacagacacgaccccattcgggcaacagcgggtttttaaggagaaagtggatactagaacaccccagccgaagcctggaaccaggatggtcatgactacaaccgccaattggctttgggctctgttaggcaaaaagaaaaacccccgcctgtgcacacgtgaggaattcatcagcaaggtgcggagtaatgccgcaattggtgccgtatttcaggaggaacaagggtggacttccgctagcgaggcggttaacgactctagattctgggaattggtggataaggagagggccctccaccaggagggaaaatgtgaatcatgcgtctacaatatgatgggcaagcgcgagaaaaagctgggcgaatttgggcgagcaaaaggaagtcgggctatatggtatatgtggctaggtgccagattccttgagttcgaagcactgggctttctcaacgaggaccattggttcgggagggagaactcctggagcggagtggaaggcgagggtctgcaccgcttggggtacatcctggaagatattgacaagaaggatggagacctcatctatgccgatgacaccgctggctgggatacgagaattaccgaggacgatcttctgaatgaggaattaatcacagagcagatggccccacatcacaaaatactggcgaaggcaatctttaaattgacttaccaaaacaaggtggtcaaagttctccggcctacccccaagggcgccgtgatggacattatctctaggaaagaccagcgtgggtcgggacaggtaggtacatacggcctgaatactttcaccaacatggaagtgcagctaattcgacaaatggaggctgaaggggtcatcacgcaggatgacatgcacaatccaaagggacttaaggagcgcgtggagaaatggctgaaggaatgcggcgttgatagactcaaacggatggccatatcaggtgacgattgtgtggtcaagcccctggacgagaggtttagcacatccttgttattcctgaacgatatggggaaagtgcgcaaggacattcctcagtgggaaccaagtaagggatggaaaaattggcaggaggtaccgttttgctctcatcacttccataagatctttatgaaagatggcagaagcctcgttgtgccctgtcggaaccaagacgaacttatcggcagggcacgaatttcccagggggctggatggtcactgcgtgagaccgcctgcctaggtaaggcttatgcccagatgtggagtctgatgtacttccacagacgcgatctccggttggcatctatggcgatatgtagcgccgtccctactgagtggtttccaacatccaggaccacttggtcaatccacgctcatcaccagtggatgaccacagaagacatgctgaaagtgtggaatagagtttggattgaggacaaccccaatatgacggataagacccctgtgcatagctgggaagacatcccatatcttggcaagcgcgaggatctgtggtgcgggtctctcattggattatccagtcgggccacttgggcaaaaaacatccacacagctataacccaagtcaggaatctgatcggcaaggaagagtacgtggactatatgcccgtaatgaaacgatacagcgcccctttcgagtcggaaggtgtgttgtga

SEQ ID NO: 15703 - RNA, 9867 nt, synthetic construct
  misc_feature 1..9867: note = derived and/or modified CDS sequence (opt3) from DENV-4__FJ024424__SS-prME
  source 1..9867: mol_type = other RNA
agcaccatcacactgctctgccttattcccactgtgatggccttccacctgtccacgcgggacggcgagcctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacaaccactattacgcctcgttcaccaagtgtagaggttaagctgccggattacggagaattaacactggactgcgagccccgcagcggcatcgacttcaacgagatgattctcatgaagatgaaaaagaaaacctggcttgtgcataagcagtggtttctggatttgcctctaccatggactgcaggggctgacacctctgaagtccactggaattacaaagagagaatggtgacattcaaggtcccccatgccaaaaggcaggatgtgaccgttctgggatcccaggaaggtgcgatgcactcagccctcgcaggcgctactgaggtggacagcggggatggaaaccacatgtttgccggccatctgaagtgtaaggtacggatggaaaaacttcgaatcaagggtatgagttatacaatgtgctctgggaaattctccatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatcagctcgacacccctggccgagaacaccaactctgttacaaatattgagttggaaccgcctttcggagactcctatatcgtcataggtgtgggcaactcagctctcactctgcattggtttaggaaagggagtagcattggaaagatgttcgagtccacctaccggggcgcgaaacgcatggcaatcttaggtgaaacggcctgggattttgggtctgtgggcggactgttcaccagcctaggcaaggctgtccaccaggtttttgggtcagtgtatacaactatgttcggaggcgtgagttggatgatcaggattctaatcggttttctggtactttggattgggaccaattccagaaacacaagcatggccatgacttgcatagcagtcggaggcatcaccttgttcctgggttttacggtgcaggccgacatgggctgtgttgtgtcttggtcagggaaggagctcaaatgcggaagtggcattttcgtcgtggataatgttcatacatggaccgaacaatacaagtttcagcccgagagcccagctcgtctggcctccgcaatccttaacgcgcacaaagacggggtgtgtggaatccggtctactacacgactggagaatgtaatgtggaagcagattaccaacgaattgaattatgtcctctgggagggcggtcacgacctgactgtggtggctggggatgtcaaaggagttttaaccaagggcaagagagccctgacacctcccgtgtcggacctaaaatacagctggaagacgtggggtaaagcaaagatattcaccccagaagccaggaactccacttttctcatcgatggccccgacacatcagagtgccctaatgaacgccgggcttggaacagtctggaggtagaggattacgggttcggaatgttcaccacaaatatttggatgaaatttagagaaggctctagcgaggtgtgtgaccataggcttatgtccgccgcaatcaaggatcagaaagctgtccacgccgacatggggtattggattgaatcaagcaagaaccaaacttggcagatcgagaaggcgtctttgatagaagtgaaaacctgcctgtggccaaagacgcatacactctggtccaatggagttctggagagtcagatgttaatcccgaaaagctacgccggccccttctctcagcacaactatcgccaaggttacgctacccagactgtggggccttggcacctgggaaaacttgagattgattttggcgaatgcccaggtaccacagtcactatccaggaggactgtgatcatcgaggcccctccttgcggaccacaacggcatcagggaaactcgtgacccagtggtgctgtcgtagttgcactatgcctccactgagattcctaggagaagacggctgttggtatgggatggagattaggcccctgagcgagaaggaagagaacatggttaagtcgcaagtggccgctggacagggcacatccgaaaccttttctatgggtctcctgtgccttactttgttcgtcgaggaatgtctgcgccggagagtaacaaggaaacacatgatcttagccgtggttataaccctctgcgcaattatcctagggggacttacgtggatggatctgttgcgagcgctcattatgctgggcgacactatgagcggccgcatcgggggacagacccatctagccataatggctgtgtttaagatgtcaccgggttacgtcctgggcgtgttcctccggaaactgacaagtagagagaccgcccttatggtaatcgggatggcaatgactacaaccttgtccattcctcacgacctgatggagttaatcgatggaatttctctcggcctgatccttctgaagatagtgacacagtttgacaatactcaagtcggtaccctagctctcagcctgacgttcattaggtccacaatgtcattggttatggcctggcgtaccatcatggcagtgctgtttgtggtcactttaatcccactctgtcgcaccagctgcctgcagaaacagagtcattgggtggaaattacagcccttatcctgggggctcaagcgttgcccgtttatctcatgactctgatgaagggagcctctcggagatcctggcctctaaacgagggcattatggcagtaggcctggtgagccttctcgggtcggctctgttgaagaatgatgtccccctggccggaccaatggtggccggtggcttactcctggctgcatacgttatgtcagggtctagtgccgacctttccctggaaaaagcggctaacgtgcagtgggatgagatggccgacataaccggaagctctcctatcattgaagtcaagcaggatgaggacggcagcttctccatcagggatgtggaggaaacgaatatgattacattgctcgtaaaactggcactaatcaccgtctcaggtctgtacccccttgccataccagtgactatgacactctggtatatgtggcaggttaagacccaacgaagtggggctctgtgggacgtgccgagccctgcagccactcagaaagcggctttgtctgagggagtctaccggatcatgcagcgcggcttatttggcaagacacaggtgggggttggcattcacatggaaggtgtgttccacaccatgtggcatgtcacgagaggctccgtgatctgtcacgagactgggaggctggaaccctcatgggccgatgtacggaacgacatgattagttatggaggcggttggcgactcggggataagtgggacaaagaggaggacgtgcaagttctggcaatcgaaccaggaaagaatcccaaacatgtccagaccaagcctggccttttcaaaacactgaccggcgagataggggccgtgacattggattttaagccaggaactagcggttcccccattatcaacagaaaaggcaaggtgatcgggctatacggaaatggcgtcgtaaccaagtctggtgactatgtgtcggctattacgcaggccgaacgcataggggagcctgattacgaggttgacgaagatatcttcaggaaaaagcgtctgacaattatggacctccacccgggagcaggcaaaactaagcggatcctgccaagcattgtgagagaggctcttaaaaggcgcttacgaaccctgatcctcgcccccacaagagtcgtggcggccgaaatggaggaagcattgcggggcctgcctataaggtatcagaccccagctgttaagtcagagcatactgggcgcgagatcgtggatctcatgtgccacgccacctttacaacgcgtctgctttccagtactagagtccccaactacaatctgattgtgatggacgaagctcacttcaccgatccttctagcgtagcagcccggggatacatctccacaagggtggagatgggtgaagccgctgcgatttttatgaccgcaactccgcccggcgccacagacccattccctcaatcaaactctcccatcgaggatatagaacgcgagattccagagcgaagctggaataccgggtttgactggatcacggactatcagggaaagactgtttggttcgtccctagtatcaaagctggcaacgatattgccaattgcttgagaaagtccggtaaaaaggtgatccagctaagccggaaaacatttgacaccgaataccccaagaccaagctgactgattgggacttcgtggtcacaaccgatatatctgagatgggggcaaactttagggccggccgcgttattgacccaagaaggtgtctcaaaccggtgatcttaacagatggacctgaacgggtaattctggctggccccatcccagtgactcccgcgtcagccgcacaacgtcgcgggcgaataggaagaaaccctacgcaggaggacgatcagtatgtcttctccggtgacccacttaagaatgatgaagaccatgctcactggaccgaggccaaaatgctgctcgataacatttacacacccgagggcatcatccctactttgttcgggccggaaagggagaagacccaggcaattgacggagaatttcggctgcgcggcgagcaaagaaaaacattcgtggagctcatgaggcggggtgacctgccagtttggcttagttataaggtggccagcgctgggatctcgtacaaggatcgagaatggtgctttaccggcgagagaaataaccagattctagaagagaatatggaagtcgagatatggactcgcgagggagagaagaagaaactgaggccccggtggttggacgcccgtgtatatgcggatcctatggcattaaaggacttcaaagagtttgcctctggcagaaagtccatcacgctggatattctcaccgaaatcgctagcctgcccacatacctttcaagtagggccaagctggctctcgacaacatcgtgatgttgcatactaccgagcgcgggggacgggcataccagcacgccctgaatgaactaccagagtctctggagacactcatgcttgttgctctgttaggtgccatgaccgcaggcattttcttgtttttcatgcaggggaaaggaataggcaagctgtccatgggtctcatcactattgcggtggccagcgggctgctttgggtcgctgaaatccaacctcagtggattgccgcatcaatcatactggagtttttcctcatggtgttgctgatccccgaaccagagaaacagcgaacacctcaggataaccaattaatttatgtcatcctaacgattctgaccatcataggcctcattgctgccaatgaaatgggacttatcgagaagactaaaacagactttggcttctaccaggtgaagaccgagaccacaattctggatgttgacttgagaccggcaagtgcctggactctgtatgctgtggcgacgaccatcctcacacccatgctgaggcacactatagaaaacaccagcgccaatctttccctcgcagctatcgccaaccaggccgcagtactgatggggttgggaaaaggctggccactgcatcgcatggatttaggtgtgcctctactggctatggggtgttactctcaggtcaatcccacaaccctcactgccagccttgttatgctgttggtgcactatgcgattatcggaccaggcctgcaagctaaggccacgcgggaggcacagaagagaacagccgctggtattatgaaaaaccctaccgtcgacggcatcactgtgatagatctcgaacccatttcctacgacccgaagtttgagaaacagctggggcaagtaatgcttttagtgctgtgcgcaggacagctcttgctgatgcgtaccacatgggccttctgtgaggttctaactctggcgaccggcccaatcctcacactttgggaagggaatcctggaaggttctggaacacgaccatcgctgtgtcaactgccaacatttttcggggctcttatctggccggtgcagggttggctttcagtctgatcaagaatgcccagacaccccgccgaggaaccggcactacaggtgagaccctcggcgaaaaatggaagagacagctgaactcgttagacaggaaggagtttgaagagtacaaacggagcgggatacttgaggtcgatcgcacggaagcaaagtccgctctgaaagacggatctaagattaaacatgccgtgtcaagaggcagctccaagatcaggtggattgtcgagcgagggatggtgaagccaaaaggaaaggttgtagatctcggctgcggtagagggggatggagttactatatggcgaccctcaaaaatgtgacagaagtcaagggctacactaaaggcgggcccggacacgaggaacctatcccgatggccacctatggttggaacctggtgaagttgcattctggcgttgacgtgttctacaagcccacagagcaagtcgatactctgctctgtgacataggggagagctcatccaatccaaccatcgaagagggacgtacacttagagtgctgaaaatggtagaaccttggttgagtagcaagcccgagttttgcattaaagtgctgaacccttatatgccaaccgttatcgaggaactcgagaagttacagcgcaaacacggcggtaatctggtcaggtgtcccctttctcggaactccactcacgaaatgtactgggtgtcaggggcaagcggaaatattgtgtcgtctgtcaacacgacaagtaagatgctgctaaatagattcaccactcgccataggaaacctacctatgagaaggatgttgacctcggcgctggcacacgatccgtgagcacggaaaccgagaagccagatatgactatcattgggcggagactgcagaggttgcaggaggaacacaaagagacatggcattacgaccaagaaaacccctaccgcacctgggcctatcacggatcatacgaggcaccgtccactggttctgctagcagtatggtaaatggcgtggtcaagctgctcacaaaaccttgggatatgatcccaatggtgacccagcttgccatgacagacactaccccctttgggcagcagcgtgttttcaaggaaaaagtggacacgcggacccctcaaccaaagcccggaacaagaatggtcatgactaccacagccaactggctgtgggcgttactgggcaagaaaaagaatccgaggttgtgcactcgcgaggagtttatatccaaagtgcgaagcaacgctgcaattggtgccgtattccaggaagaacaggggtggacctctgcttcagaagccgttaatgatagtcggttttgggagctcgtggacaaggaaagagcactgcaccaagagggaaaatgtgagtcctgcgtctataacatgatgggcaagagggaaaagaaactaggcgagttcgggcgcgccaagggaagcagagctatctggtacatgtggcttggtgcgcggtttctggagttcgaggccctcggcttcctgaacgaagatcattggtttgggagggaaaattcttggtcgggagtggagggcgaaggtttgcaccgtctggggtatatcctcgaggaaattgacaaaaaggatggagaccttatgtacgcagatgacacggctggctgggatacacgaataaccgaggacgatctgcagaacgaggaattaatcactgagcagatggcccctcatcacaaaattctggcaaaggccatcttcaagttgacatatcagaataaagtggtcaaggttctccgccccaccccaagaggcgctgtgatggacattatctcacggaaagatcaaagggggagcggacaggtaggtacttacggcctgaacacctttacaaatatggaagtgcagctaatacgccagatggaggccgaaggggtcatcacgcaagacgacatgcagaaccctaagggacttaaagagagagtggagaagtggctgcgggaatgcggcgttgataggctcaaacgaatggcgatttccggtgacgattgtgtggtcaagcccctggacgagcgtttcgggaccagtttgttatttctgaatgatatgggaaaggtgagaaaagacatcccacagtgggaaccctctaagggctggaaaaactggcaggaggtacctttctgcagccatcactttcacaagattttcatgaaagatggccgctccctcgttgtgccatgtcggaatcaagacgaacttatcgggagggcaagaatatcacagggagccggttggagtctgcgcgagactgcttgcctaggcaaggcctacgcacagatgtggtctctgatgtattttcatcggagggatctccgattggctagcatggccatttgttccgctgtcccgacagagtggttccccacctcaagaactacatggagcatccacgcccatcaccagtggatgaccacggaagacatgctgaaggtgtggaaccgggtttggatcgaggataatcctaacatgattgacaaaacaccagtgcactcttgggaagacataccctaccttgggaagagggaggatctgtggtgcggatccctcatcggcttaagtagccgcgcaacctgggcgaaaaatattcatactgccatcacccaagtccgtaacctgattggtaaggaagagtatgtggactacatgcctgtaatgaaaagatattcggctccatccgagtctgaaggggtgttgtga

SEQ ID NO: 15704 - RNA, 9867 nt, synthetic construct
  misc_feature 1..9867: note = derived and/or modified CDS sequence (opt3) from DENV-4__EU854295__SS-prME
  source 1..9867: mol_type = other RNA
agcaccatcacactgctctgccttattcccactgtgatggccttccacctgtccacgcgggacggagagcctttgatgatagtcgctaagcatgaaagggggcggccattactgtttaaaaccaccgagggaatcaacaagtgtactctgattgccatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctcatcggttttctggtactttggattgggactaattccagaaacaccagcatggcaatgacatgcatagccgtcggaggcatcactttgttcctgggttttaccgtgcaggctgacatgggctgtgttgtgtcttggtcagggcgtgagctcaagtgcggaagtggcattttcgtcgtggataatgttcatacgtggacagaacaatacaaatttcagcccgagagcccagcccggctggcatccgcgatccttaacgctcacaaggacggggtgtgtggaatccgatctaccactagactggagaatgtaatgtggaaacagattacaaacgaattgaattatgtcctctgggagggcggtcacgacctgaccgtggtggccggggatgtcaagggagttttaactaaaggcaagagggcactgacccctcccgtgtcggacctaaagtacagctggaaaacatggggtaaggccaaaatattcacgccagaagctcgcaactccacctttctcatcgatggccccgacacttcagagtgccctaatgaacggagagcctggaacagtctggaggtagaggattacgggttcggaatgttcacaaccaatatttggatgaagtttagggaaggctctagcgaggtgtgtgaccatcgccttatgtccgcagctatcaaagatcagaaggccgtccacgcggacatggggtattggattgaatcaagcaaaaaccaaacatggcagatcgagaaggcctctttgatagaagtgaagacttgcctgtggccaaaaacccatacgctctggtccaatggagttctggagagtcagatgttaatcccgaaaagctacgctggccccttctctcagcacaactatcgacaaggttacgcaacacagaccgtggggccttggcacctgggaaaacttgagattgattttggcgaatgcccaggtactaccgtcacaatccaggaggactgtgatcatcggggcccctccttgcgtactaccacagcctcagggaagctcgtgacgcagtggtgctgtagaagttgcaccatgcctccactgaggttcctaggagaagacggctgttggtatgggatggagattcgccccctgagcgagaaagaagagaacatggttaagtcgcaagtggctgccggaccgggcacttccgaaacattttctatgggtctcctgtgccttaccttgttcgtcgaggaatgtctgcggagaagggtaactcgaaagcacatgatcttagcagtggttataacactctgcgcgattatcctagggggacttacctggatggatctgttgcgcgccctcattatgctgggcgacacgatgagcggccggatcgggggacagactcatctagctataatggccgtgtttaaaatgtcacctggttacgtcctgggcgtgttcctcagaaagctgaccagtagggagacagcacttatggtaatcgggatggctatgaccactacattgtccattccacacgacctgatggagttaatcgatggaatttctctcggcctgatccttctgaaaatagtgacccagtttgacaatacacaggtcggtactctagccctcagcctgaccttcattcgttccacgatgtcattggttatggcatggcgcacaatcatggccgtgctgtttgtggtcaccttaatccccctctgtcggactagctgcctgcaaaagcagagtcattgggtggaaattaccgctcttatcctgggggcgcaggccttgcctgtttatctcatgacactgatgaaaggagcatctagaaggtcctggcccctaaacgagggcattatggctgtaggcctggtgagccttctcgggtcggccctgttgaagaatgatgtcccactggccggacctatggtggctggtggcttactcctggcagcctacgttatgtcagggtctagtgcggacctttccctggaaaaggctgccaacgtgcaatgggatgagatggcagacataactggaagctctcccatcattgaagtcaaacaggatgaggacggcagcttctccatccgagatgtggaggaaaccaatatgattacgttgctcgtaaagctggccctaatcacagtctcaggtctgtacccacttgctataccggtgaccatgactctctggtatatgtggcaggttaaaacacagcggagtggggcactgtgggacgtgcctagccccgccgcgacccaaaaggctgccttgtctgagggagtctaccgcatcatgcagagaggcttatttggcaaaactcaggtgggggttggcattcacatggaaggtgtgttccacacaatgtggcatgtcaccaggggctccgtgatctgtcacgagacggggcggctggaaccatcatgggcagatgtacgaaacgacatgattagttatggaggcggttggagactcggggataagtgggacaaggaggaggacgtgcaggttctggccatcgaacccggcaaaaatcctaagcatgtccaaactaaaccaggccttttcaagaccctgacaggcgagataggggctgtgaccttggattttaaacccggaacaagcggttcccctattatcaaccgcaagggcaaagtgatcgggctatacggaaatggcgtcgtaactaagtctggtgactatgtgtcggccattacccaggcagaaaggataggggagccggattacgaggttgacgaagatatcttccgtaagaaacggctgacgattatggacctccacccaggagctggcaagacaaaaagaatcctgcccagcattgtgagggaggcccttaagcgccgattaagaactctgatcctcgcgcctacccgggtcgtggccgcagaaatggaggaggctttgaggggcctgccaatacgctatcagacacccgccgttaaatcagagcataccgggcgtgagatcgtggatctcatgtgccacgctacttttaccacaagactgctttccagtacgcgggtccctaactacaatctgattgtgatggacgaagcacacttcactgatccgtctagcgtagccgccaggggatacatctccacccgcgtggagatgggtgaagctgcggcaatttttatgacagccacacccccaggcgctactgaccctttcccccagtcaaactctccaatcgaggatatagaacgagagattcctgagagaagctggaatacagggtttgactggatcaccgactatcaaggaaagacggtttggttcgtccccagtatcaaggccggcaacgatattgcaaattgcttgcggaaatccggtaagaaagtgatccagctaagcaggaagacttttgacacagaatacccaaaaaccaagctgaccgattgggacttcgtggtcactacagatatatctgagatgggggccaactttcgcgctggcagagttattgacccgaggcggtgtctcaagcctgtgatcttaaccgatggacccgaacgtgtaattctggcgggcccaatccccgtgactcctgcctcagcagctcagcgccgagggagaataggaaggaacccagcccaagaggacgatcagtatgtcttctccggtgacccccttaaaaatgatgaagaccatgcacactggactgaggccaagatgctgctcgataacatttacacgcctgagggcatcatcccgaccttgttcgggccagaacgggagaaaacacaggctattgacggagaatttcgcctgagaggcgagcagaggaagactttcgtggagctcatgcggcgaggtgacctgcccgtttggcttagttataaagtggccagcgcggggatctcgtacaaggatagagaatggtgctttaccggcgagcgcaataaccaaattctagaagagaatatggaagtcgagatatggacaagggagggagaaaagaaaaagctgcggcctcgttggttggacgcaagagtatatgccgatcccatggctttaaaagacttcaaggagtttgcctctggcaggaaatccatcaccctggatattctcactgaaatcgctagcctgccaacgtacctttcaagtcgcgcaaagctggccctcgacaacatcgtgatgttgcataccacagagagagggggacgagcttaccagcacgccctgaatgaactacctgagtctctggagactctcatgcttgttgcactgttaggtgcgatgaccgccggcattttcttgtttttcatgcaggggaagggaataggcaaactgtccatgggtctcatcacaattgctgtggccagcgggctgctttgggtcgcagaaatccagccccaatggattgctgcctcaatcatactggagtttttcctcatggtgttgctgatcccagaacctgagaagcagagaaccccgcaggataaccagttaatttatgtcatcctaactattctgacaatcataggcctcattgcagccaatgaaatgggacttatcgagaaaacgaagaccgactttggcttctaccaagtgaaaactgagacaaccattctggatgttgacttgaggcccgctagtgcgtggaccctgtatgccgtggcaacaactatcctcacgccaatgctgcgccacaccatagaaaacacaagcgctaatctttccctcgccgccatcgcaaaccaggctgccgtactgatggggttgggaaagggctggcctctgcatcggatggatttaggtgtgcccctactggcgatggggtgttactctcaggtcaatccaactaccctcacagctagccttgttatgctgttggtgcactatgccattatcggacctggcctgcaggcaaaagccaccagagaggctcaaaagcgtactgcagccggtattatgaagaaccccacggtcgacggcatcacagtgatagatctcgaaccgatttcctacgacccaaaatttgagaagcagctggggcaggtaatgcttttagtgctgtgcgcgggacaactcttgctgatgaggaccacttgggctttctgtgaggttctaaccctggccacaggccctatcctcactctttgggaagggaatcccggacggttctggaacaccacaatcgcagtgtcaacggccaacatttttcgcggctcttatctggctggtgccgggttggcattcagtctgatcaaaaatgctcagaccccacgaagaggaactggcacaaccggtgagactctcggcgaaaagtggaaaaggcagctgaactcgttagaccggaaggagtttgaagagtacaagcgcagcgggatacttgaggtcgatagaacagaagccaaatccgcgctgaaggacggatctaaaattaagcatgccgtgtcaaggggcagctccaaaatccgatggattgtcgagcgggggatggtgaagcccaagggaaaagttgtagatctcggctgcggtcgtgggggatggagttactatatggcaaccctaaagaatgtgacggaagtcaaaggctacaccaagggcgggcctggacacgaggaaccgatccccatggctacatatggttggaacctggtgaaattgcattctggcgttgacgtgttctacaagccaactgagcaggtcgataccctgctctgtgacataggggagagctcatccaatcctacaatcgaagagggaagaactcttcgcgtgctgaagatggtagaaccctggttgagtagcaaacctgagttttgcattaaggtgctgaacccatatatgcccaccgttatcgaggaactcgagaaattacaaaggaagcacggcggtaatctggtccggtgtcctctttctagaaactccacacacgaaatgtactgggtgtcaggggccagcggaaatattgtgtcgtctgtcaacaccacaagtaaaatgctgctaaatcgcttcacgacaaggcatcgaaagccaacctatgagaaagatgttgacctcggcgcaggcactcggtccgtgagcaccgaaacagagaagcccgatatgacgatcattgggagaaggctgcagcgcttgcaggaggaacacaaggagacctggcattacgaccaggaaaacccgtaccgtacttgggcttatcacggatcatacgaggccccttccacaggttctgccagcagtatggtaaatggcgtggtcaaactgctcaccaagccatgggatgtgatccccatggttactcaacttgcgatgacagacaccacaccttttgggcagcagcgggtgttcaaagaaaaggtcgacactagaaccccacagcccaaaccgggaacgagggtggtaatgaccacaactgctaactggctgtgggcattactgggcaagaagaaaaatcctcgcttgtgcacccgagaggagtttatatccaaggttcggagcaacgccgctattggtgccgtgttccaagaagaacaggggtggacatctgcatcagaagccgtcaatgatagtagattttgggagctcgtggacaaagaaagggctctgcaccaggagggaaagtgtgagtcctgcgtgtataacatgatgggcaaacgcgaaaagaagctaggcgagttcgggagagcgaaaggaagccgggccatctggtacatgtggcttggtgcaaggtttctggagttcgaggctctcggcttcctgaacgaagatcattggtttgggcgtgaaaattcttggtcgggagtcgagggcgaaggtttgcaccgactggggtatatcctcgaggaaattgacaagaaagatggagaccttatgtacgccgatgacactgcaggctgggatacccgcataacggaggacgatctgcaaaacgaggaattaatcacagagcagatggcaccccatcacaagattctggctaaagccatcttcaagttgacctatcagaataaggttgtgaaagtactcagaccaactcctcggggcgcggtgatggacattatctcaaggaaggatcagcgcgggagcggacaagtcggtacatacggcctgaacacctttactaatatggaagtgcagctaataagacagatggaggcagaaggggttatcacccaggacgacatgcaaaaccccaaaggacttaaggagcgggtggagaaatggctgagggaatgcggcgtcgatcgactcaagcgtatggccatttccggtgacgattgtgtggtaaaaccactggacgagagattcgggacaagtttgttatttctgaatgatatgggaaaggttcgcaaggacatcccccagtgggaaccttctaaaggctggaagaactggcaggaggtgccattctgcagccatcactttcacaaaattttcatgaaggatggccggtccctcgtcgtgccgtgtaggaatcaggacgaacttatcgggagagctcgcatatcacaaggagccggttggagtctgcgggagacggcatgcctaggcaaggcttacgcccagatgtggtctctgatgtattttcataggcgagatctcagattggctagcatggccatttgttccgcagttcccaccgagtggttccctacttcacggacaacctggagcatccacgcgcatcaccagtggatgactacagaagacatgctgaaggtgtggaacagggtctggatcgaggataatccaaacatgattgacaagacccccgtgcactcttgggaagacataccttaccttgggaaacgcgaggatctgtggtgcggatccctcatcggcttaagtagccgtgccacgtgggctaagaatattcatacagccatcacccaggtaagaaacctgattggtaaagaagagtatgtggactacatgccagtcatgaagcgatattcggcaccctccgagtctgaaggggttttgtga

SEQ ID NO: 15705 - RNA, 9867 nt, synthetic construct
  misc_feature 1..9867: note = derived and/or modified CDS sequence (opt3) from DENV-4__EU854296__SS-prME
  source 1..9867: mol_type = other RNA
agcaccatcactctgctctgccttattcccactgtgatggccttccacctgtccacgcgggacggagagcctttgatgatagtcgctaagcatgaaagggggcggccgttactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccagcgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctcatcggttttctggtactttggattgggactaattccagaaacaccagcatggcaatgacatgcatagccgtcggaggcatcactttgttcctgggttttaccgtgcaggctgacatgggctgtgttgtgtcttggtcagggcgtgagctcaagtgcggaagtggcattttcgtcgtggataatgttcatacgtggacagaacaatacaaatttcagcccgagagcccagcccggctggcatccgcgatccttaacgctcacaaggacggggtgtgtggaatccgatctaccactagactggagaatgtaatgtggaaacagattacaaacgaattgaattatgtcctctgggagggcggtcacgacctgaccgtggtggccggggatgcaaagggagtcttaactaaaggcaagagggccctgacccctcccgtttcggacctaaagtacagctggaaaacatggggtaaggctaaaatattcacgccagaagcccgcaactccacctttctcatcgatggccccgacacttcagagtgccctaatgaacggagagcatggaacagtctggaggtggaggattacgggttcggaatgttcacaaccaatatttggatgaagtttagggaaggctctagcgaggtatgtgaccatcgccttatgtccgctgccatcaaagatcagaaggcggtgcacgccgacatggggtattggattgaatcaagcaaaaaccaaacatggcagatcgagaaggcttctttgatagaagtcaagacttgcctgtggccaaaaacccatacgctctggtccaatggagtgctggagagtcagatgttaatcccaaagagctacgcaggccccttctctcagcacaactatcgacaaggttacgccacacagaccgttgggccttggcacctgggaaaacttgagattgattttggcgaatgcccaggtactaccgtgacaatccaggaggactgtgatcatcggggcccctccttgcgtactaccacagcttcagggaagctcgtcacgcagtggtgctgtagaagttgcaccatgcctccactgaggttcctaggagaagacggctgttggtatgggatggagattcgccccctgagcgagaaagaagagaacatggtgaagtcgcaagttactgccggacagggcacatccgaaaccttttctatgggtctcctgtgccttactttgttcgtggaggaatgtctgcggagaagggtcacacgaaagcacatgatcttagcagtagtgataaccctctgcgcgattatcctagggggacttacgtggatggatctgttgcgcgccctcattatgctgggcgacactatgagcggccggatcgggggacagacccatctagctataatggccgtttttaaaatgtcaccgggttacgtgctgggcgtcttcctcagaaagctgacaagtagggagaccgcacttatggtgatcgggatggctatgactacaaccttgtccattcctcacgacctgatggagttaatcgatggaatttctctcggcctgatccttctgaaaatagtaacacagtttgacaatactcaagtgggtaccctagccctcagcctgacgttcattcgttccacaatgtcattggtcatggcatggcgcaccatcatggccgttctgtttgtggtgactttaatcccactctgtcggaccagctgcctgcagaagcagagtcattgggtcgaaattacagctcttatcctgggggcgcaagccttgcccgtgtatctcatgactctgatgaaaggagcatctagaaggtcctggcctctaaacgagggcattatggctgttggcctggtaagccttctcgggtcggccctgttgaagaatgatgtgcccctggccggaccaatggtcgctggtggcttactcctggcagcctacgtgatgtcagggtctagtgcggacctttccctggaaaaggctgccaacgttcagtgggatgagatggcagacataaccggaagctctcctatcattgaagtgaaacaggatgaggacggcagcttctccatccgagatgtcgaggaaacgaatatgattacattgctcgtgaagctggccctaatcaccgtatcaggtctgtacccccttgctataccagtcactatgacactctggtatatgtggcaagtgaaaacccaacggagtggggcactgtgggacgttccgagccctgccgcgactcagaaggctgccttgtctgagggagtgtaccgcatcatgcagagaggcttatttggcaaaacacaggtcggggtgggcattcacatggaaggtgttttccacaccatgtggcatgtgacgaggggctccgtcatctgtcacgagactgggcggctggaaccctcatgggcagatgtgcgaaacgacatgattagttatggaggcggttggagactcggggataagtgggacaaggaggaggacgtacaagtgctggccatcgaaccaggcaaaaatcccaagcatgttcagaccaaacctggccttttcaagacactgaccggcgagataggggctgtcacattggattttaaaccaggaactagcggttcccccattatcaaccgcaagggcaaagtgatcgggctatacggaaatggcgtggtcaccaagtctggtgactatgtatcggccattacgcaggcagaaaggataggggagcctgattacgaggtggacgaagatatcttccgtaagaaacggctgacaattatggacctccacccgggagctggcaagactaaaagaatcctgccaagcattgttagggaggcccttaagcgccgattaagaaccctgatcctcgcgcccacacgggtggtcgccgcagaaatggaggaggctttgaggggcctgcctatacgctatcagaccccagccgtgaaatcagagcatactgggcgtgagatcgttgatctcatgtgccacgctacctttacaacgagactgctttccagtactcgggtgcccaactacaatctgattgtcatggacgaagcacacttcaccgatccttctagcgtggccgccaggggatacatctccacacgcgtagagatgggtgaagctgcggcaatttttatgaccgccactccgcccggcgctacagacccattccctcaatcaaactctcccatcgaggatatagaacgagagattccagagagaagctggaataccgggtttgactggatcacggactatcagggaaagactgtgtggttcgttcctagtatcaaggccggcaacgatattgcaaattgcttgcggaaatccggtaagaaagtcatccagctaagcaggaagacatttgacaccgaataccccaaaaccaagctgactgattgggacttcgtggtgacaaccgatatatctgagatgggggccaactttcgcgctggcagagtcattgacccaaggcggtgtctcaagccggttatcttaacagatggacctgaacgtgtgattctggcgggccccatcccagtaactcccgcctcagcagctcaacgccgagggagaataggaaggaaccctgcccaggaggacgatcagtatgtgttctccggtgacccacttaaaaatgatgaagaccatgcacactggacggaggccaagatgctgctcgataacatttacacccccgagggcatcatccctacattgttcgggccggaacgggagaaaactcaggctattgacggagaatttcgcctgagaggcgagcaaaggaagaccttcgtcgagctcatgcggcgaggtgacctgccagtgtggcttagttataaagttgccagcgcggggatctcgtacaaggatagagaatggtgctttacaggcgagcgcaataaccagattctagaagagaatatggaagtggagatatggaccagggagggagaaaagaaaaagctgcggccccgttggttggacgcaagagtctatgccgatcctatggctttaaaagacttcaaggagtttgcctctggcaggaaatccatcactctggatattctcacggaaatcgctagcctgcccacctacctttcaagtcgcgcaaagctggccctcgacaacatcgtaatgttgcatacaactgagagagggggacgagcttaccagcacgccctgaatgaactaccagagtctctggagaccctcatgcttgtggcactgttaggtgcgatgacagccggcattttcttgtttttcatgcaggggaagggaataggcaaactgtccatgggtctcatcaccattgctgttgccagcgggctgctttgggtggcagaaatccaacctcagtggattgctgcctcaatcatactggagtttttcctcatggtcttgctgatccccgaaccagagaagcagagaactcctcaggataaccaattaatttatgtgatcctaacaattctgacgatcataggcctcattgcagccaatgaaatgggacttatcgagaaaaccaagactgactttggcttctaccaggctaaaacagagaccaccattctggatgtcgacttgaggccggcgagtgcctggacactgtatgcagtggctactacgatcctcacccccatgctgcgccacacaatagaaaacactagcgccaatctttccctcgccgcaatcgctaaccaggccgcggttctgatggggttgggaaagggctggccactgcatcggatggatttaggtgtgcctctactggctatggggtgttactctcaggtaaatcccaccacactcaccgccagccttgtgatgctgttggtccactatgcaattatcggaccaggcctgcaagccaaagctactagagaggcacagaagcgtacggccgcgggtattatgaagaaccctacagttgacggcatcaccgtgatagatctcgaacccatttcctacgacccgaaatttgagaagcagctggggcaagtcatgcttttagtgctgtgcgctggacagctcttgctgatgaggactacctgggccttctgtgaggtactaacactggcaactggcccaatcctcaccctttgggaagggaatcctggacggttctggaacacaacgatcgccgtgtcaaccgctaacatttttcgcggctcttatctggccggtgcagggttggctttcagtctgatcaaaaatgcccagactccccgaagaggaacaggcaccataggtgagactctcggcgaaaagtggaaaaggcagctgaactcgttagaccggaaggagtttgaagagtacaagcgcagcgggattcttgaggttgatagaacagaagcgaaatccgccctgaaggacggatctaaaatcaagcatgcagtgtcaaggggcagctccaaaattcgatggatcgtcgagcgggggatggtgaagccaaagggaaaagtcgtggatctcggctgcggtcgtgggggatggagttactatatggctaccctaaagaatgttacggaagtaaaaggctacaccaagggcgggcccggacacgaggaacctataccgatggccacatatggttggaacctggtgaaattgcattctggcgtcgacgtgttctacagacccactgagcaagttgataccctgctctgtgacatcggggagagctcatccaatccaacaattgaagagggacgcactcttagggtgctgaagatggtcgaaccttggttgagtagcaagcccgagttttgcatcaaagtgctgaacccttatatgccaaccgtaattgaagaactcgagaagttacagcggaaacacggcggtaatctggtgagatgtcccctttctcgcaactccacacacgaaatgtactgggtttcaggggcaagcggaaatatcgtctcgtctgtgaacaccacaagtaagatgctgctaaataggttcacgacacgacatcggaaacctacctatgagaaggatgtggacctcggcgctggcactagatccgtcagcaccgaaacagagaaaccagatatgacgattatcgggaggcgcctgcagcgtttgcaggaggaacacaaggagacctggcattacgaccaagaaaacccctaccggacttgggcctatcacggatcatacgaggccccgtccacaggttctgcgagcagtatggttaatggcgtggtaaagctgctcaccaaaccttgggatgtgataccaatggtcactcagcttgctatgacagacaccacaccctttgggcagcagagagtgttcaaggaaaaagttgacactaggacccctcaaccaaagcccggaacgcgcatggtgatgaccacaactgcaaactggctgtgggccttactgggcaaaaagaagaatccgcgattgtgcacccgggaggagtttatttccaaagtcagaagcaacgctgccatcggtgcagtgttccaggaagaacaggggtggacatctgcctcagaagctgtaaatgatagtaggttttgggagctcgttgacaaggaacgcgcgctgcaccaagagggaaaatgtgagtcctgcgtgtataacatgatgggcaagagagagaaaaagctaggcgagttcgggcgggccaagggaagcagggcaatctggtacatgtggcttggtgctcgttttctggagttcgaggccctcggcttcctgaacgaagatcattggtttgggcgagaaaattcttggtcgggagtcgagggcgaaggtttgcaccgcctggggtatattctcgaggaaatagacaaaaaggatggagaccttatgtacgcagatgacactgccggctgggataccagaatcacggaggacgatctgcagaacgaggaattaattacagagcagatggctcctcatcacaaaatcctggccaaggcgattttcaaattgacctatcagaataaggtggtgaaggtcctccggcccactccaaggggcgcagttatggacatcatatcacgcaaagatcaaagagggagcggacaggtgggtacatacggcctgaacacctttactaatatggaagtacagctaatccggcagatggaggccgaaggggtgattacccaagacgacatgcagaaccctaagggacttaaagagagggtcgagaagtggctgcgagaatgcggcgtggatcgtctcaaaagaatggctatctccggtgacgattgtgttgtgaagcccctggacgagcgcttcgggacaagtttgttatttctgaatgatatgggaaaagtccggaaggacattccacagtgggaaccctctaagggctggaaaaactggcaggaggtgcctttctgcagccatcactttcacaagatcttcatgaaagatggcaggtccctcgtagttccatgtagaaatcaagacgaacttatagggcgcgcccggatttcacagggagcaggttggagtctgagggagacggcttgcctaggcaaggcctacgctcagatgtggtctctgatgtattttcatcgaagagatctccggttggccagcatggcaatctgttccgcggtgccgaccgagtggttccccacttcaaggacaacctggagcatccacgcccatcaccagtggatgactacagaagacatgctgaaagtctggaaccgcgtgtggattgaggataatcctaacatgatagacaagaccccagttcactcttgggaagacatcccctaccttgggaagcgtgaggatctgtggtgcggatccctcattggcttaagtagcagagctacgtgggccaaaaatatccatacagcaattacccaagtgcgaaacctgatcggtaaggaagagtatgtcgactacatgcctgtgatgaaaaggtattcggctccatccgagtctgaaggggtattgtga

SEQ ID NO: 15706 - RNA, 9867 nt, synthetic construct
  misc_feature 1..9867: note = derived and/or modified CDS sequence (opt3) from DENV-4__GQ199878__SS-prME
  source 1..9867: mol_type = other RNA
agcaccatcactctgctctgccttattcccactgtgatggccttccacctgtccacgcgggacggagagcctttgatgatagtcgctaagcatgaaagggggcggccattactgtttaaaaccaccgagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctcatcggttttctggtactttggattgggactaattccagaaacaccagcatggcaatgacatgcatagccgtcggaggcatcactttgttcctgggttttaccgtgcaggctgacatgggctgtgttgtgtcttggtcagggcgtgagctcaagtgcggaagtggcattttcgtcgtggataatgttcatacgtggacagaacaatacaaatttcagcccgagagcccagcccggctggcatccgcgatccttaacgctcacaaggacggggtgtgtggaatccgatctaccactagactggagaatgtaatgtggaaacagattacaaacgaattgaattatgtcctctgggagggcggtcacgacctgaccgtggtggccggggatgtcaagggagttttaactaaaggcaagagggcactgacccctcccgtgtcggacctaaagtacagctggaaaacatggggtaaggccaaaatattcacgccagaagctcgcaactccacctttctcatcgatggccccgacacttcagagtgccctaatgaacggagagcctggaacagtctggaggtagaggattacgggttcggaatgttcacaaccaatatttggatgaagtttagggaaggctctagcgaggtgtgtgaccatcgccttatgtccgcagctatcaaagatcagaaggccgtccacgcggacatggggtattggattgaatcaagcaaaaaccaaacatggcagatcgagaaggcctctttgatagaagtgaagacttgcctgtggccaaaaacccatacgctctggtccaatggagttctggagagtcagatgttaatcccgaaaagctacgctggccccttctctcagcacaactatcgacaaggttacgcaacacagaccgtggggccttggcacctgggaaaacttgagattgattttggcgaatgcccaggtactaccgtcacaatccaggaggactgtgatcatcggggcccctccttgcgtactaccacagcctcagggaagctcgtgacgcagtggtgctgtagaagttgcaccatgcctccactgaggttcctaggagaagacggctgttggtatgggatggagattcgccccctgagcgagaaagaagagaacatggttaagtcgcaagtggctgccggacagggcacttccgaaacattttctatgggtctcctgtgccttaccttgttcgtcgaggaatgtctgcggagaagggtaactcgaaagcacatgatcttagcagtggttataacactctgcgcgattatcctagggggacttacctggatggatctgttgcgcgccctcattatgctgggcgacacgatgagcggccggatcgggggacagactcatctagctataatggccgtgtttaaaatgtcaccgggttacgtcctgggcgtgttcctcagaaagctgaccagtagggagacagcacttatggtaatcgggatggctatgaccactacattgtccattcctcacgacctgatggagttaatcgatggaatttctctcggcctgatccttctgaaaatagtgacccagtttgacaatacacaagtcggtactctagccctcagcctgaccttcattcgttccacgatgtcattggttatggcatggcgcacaatcatggccgtgctgtttgtggtcaccttaatcccactctgtcggactagctgcctgcagaagcagagtcattgggtggaaattaccgctcttatcctgggggcgcaagccttgcccgtttatctcatgacactgatgaaaggagcatctagaaggtcctggcctctaaacgagggcattatggctgtaggcctggtgagccttctcgggtcggccctgttgaagaatgatgtccccctggccggaccaatggtggctggtggcttactcctggcagcctacgttatgtcagggtctagtgcggacctttccctggaaaaggctgccaacgtgcagtgggatgagatggcagacataactggaagctctcctatcattgaagtcaaacaggatgaggacggcagcttctccatccgagatgtggaggaaaccaatatgattacgttgctcgtaaagctggccctaatcacagtctcaggtctgtacccccttgctataccagtgaccatgactctctggtatatgtggcaggttaaaacacaacggagtggggcactgtgggacgtgccgagccctgccgcgacccagaaggctgccttgtctgagggagtctaccgcatcatgcagagaggcttatttggcaaaactcaggtgggggttggcattcacatggaaggtgtgttccacacaatgtggcatgtcaccaggggctccgtgatctgtcacgagacggggcggctggaaccctcatgggcagatgtacgaaacgacatgattagttatggaggcggttggagactcggggataagtgggacaaggaggaggacgtgcaagttctggccatcgaaccaggcaaaaatcccaagcatgtccagactaaacctggccttttcaagaccctgacaggcgagataggggctgtgaccttggattttaaaccaggaacaagcggttcccccattatcaaccgcaagggcaaagtgatcgggctatacggaaatggcgtcgtaactaagtctggtgactatgtgtcggccattacccaggcagaaaggataggggagcctgattacgaggttgacgaagatatcttccgtaagaaacggctgacgattatggacctccacccgggagctggcaagacaaaaagaatcctgccaagcattgtgagggaggcccttaagcgccgattaagaactctgatcctcgcgcccacccgggtcgtggccgcagaaatggaggaggctttgaggggcctgcctatacgctatcagacaccagccgttaaatcagagcataccgggcgtgagatcgtggatctcatgtgccacgctacttttaccacaagactgctttccagtacgcgggtccccaactacaatctgattgtgatggacgaagcacacttcactgatccttctagcgtagccgccaggggatacatctccacccgcgtggagatgggtgaagctgcggcaatttttatgacagccaccccgcccggcgctactgacccattccctcaatcaaactctcccatcgaggatatagaacgagagattccagagagaagctggaatacagggtttgactggatcaccgactatcagggaaagacggtttggttcgtccctagtatcaaggccggcaacgatattgcaaattgcttgcggaaatccggtaagaaagtgatccagctaagcaggaagacttttgacacagaataccccaaaaccaagctgaccgattgggacttcgtggtcactacagatatatctgagatgggggccaactttcgcgctggcagagttattgacccaaggcggtgtctcaagccggtgatcttaaccgatggacctgaacgtgtaattctggcgggccccatcccagtgacacccgcctcagcagctcaacgccgagggagaataggaaggaaccctgcccaggaggacgatcagtatgtcttctccggtgacccacttaaaaatgatgaagaccatgcacactggactgaggccaagatgctgctcgataacatttacacgcccgagggcatcatccctaccttgttcgggccggaacgggagaaaacacaggctattgacggagaatttcgcctgagaggcgagcaaaggaagactttcgtggagctcatgcggcgaggtgacctgccagtttggcttagttataaagtggccagcgcggggatctcgtacaaggatagagaatggtgctttaccggcgagcgcaataaccagattctagaagagaatatggaagtcgagatatggacaagggagggagaaaagaaaaagctgcggccccgttggttggacgcaagagtatatgccgatcctatggctttaaaagacttcaaggagtttgcctctggcaggaaatccatcaccctggatattctcactgaaatcgctagcctgcccacgtacctttcaagtcgcgcaaagctggccctcgacaacatcgtgatgttgcataccacagagagagggggacgagcttaccagcacgccctgaatgaactaccagagtctctggagactctcatgcttgttgcactgttaggtgcgatgaccgccggcattttcttgtttttcatgcaggggaagggaataggcaaactgtccatgggtctcatcacaattgctgtggccagcgggctgctttgggtcgcagaaatccaacctcagtggattgctgcctcaatcatactggagtttttcctcatggtgttgctgatccccgaaccagagaagcagagaacccctcaggataaccaattaatttatgtcatcctaactattctgacaatcataggcctcattgcagccaatgaaatgggacttatcgagaaaacgaagaccgactttggcttctaccaggtgaaaactgagacaaccattctggatgttgacttgaggccggctagtgcgtggaccctgtatgccgtggcaacaactatcctcacgcccatgctgcgccacaccatagaaaacacaagcgctaatctttccctcgccgccatcgcaaaccaggctgccgtactgatggggttgggaaagggctggccactgcatcggatggatttaggtgtgcctctactggcgatggggtgttactctcaggtcaatcccactaccctcacagctagccttgttatgctgttggtgcactatgccattatcggaccaggcctgcaagcaaaagccaccagagaggctcagaagcgtactgcagccggtattatgaagaaccctacggtcgacggcatcacagtgatagatctcgaacccatttcctacgacccgaaatttgagaagcagctggggcaagtaatgcttttagtgctgtgcgcgggacagctcttgctgatgaggaccacttgggctttctgtgaggttctaaccctggccacaggcccaatcctcactctttgggaagggaatcctggacggttctggaacaccacaatcgcagtgtcaacggccaacatttttcgcggctcttatctggctggtgccgggttggcattcagtctgatcaaaaatgctcagacaccccgaagaggaactggcacaaccggtgagactctcggcgaaaagtggaaaaggcagctgaactcgttagaccggaaggagtttgaagagtacaagcgcagcgggatacttgaggtcgatagaacagaagccaaatccgcgctgaaggacggatctaaaattaagcatgccgtgtcaaggggcagctccaaaatccgatggattgtcgagcgggggatggtgaagccaaagggaaaagttgtagatctcggctgcggtcgtgggggatggagttactatatggcaaccctaaagaatgtgacggaagtcaaaggctacaccaagggcgggcccggacacgaggaacctatcccgatggctacatatggttggaacctggtgaaattgcattctggcgttgacgtgttctacaagcccactgagcaagtcgataccctgctctgtgacataggggagagctcatccaatccaacaatcgaagagggaagaactcttcgcgtgctgaagatggtagaaccttggttgagtagcaaacccgagttttgcattaaggtgctgaacccttatatgccaaccgttatcgaggaactcgagaaattacagaggaagcacggcggtaatctggtccggtgtcccctttctagaaactccacacacgaaatgtactgggtgtcaggggccagcggaaatattgtgtcgtctgtcaacaccacaagtaaaatgctgctaaatcgcttcacgacaaggcatcgaaagcctacctatgagaaagatgttgacctcggcgcaggcactcggtccgtgagcaccgaaacagagaagccagatatgacgatcattgggagaaggctgcagcgcttgcaggaggaacacaaggagacctggcattacgaccaagaaaacccctaccgtacttgggcttatcacggatcatacgaggccccgtccacaggttctgccagcagtatggtaaatggcgtggtcaaactgctcaccaagccttgggatgtgatcccaatggttactcagcttgcgatgacagacaccacaccctttgggcagcagcgggtgttcaaagaaaaggtcgacactagaacccctcaaccaaaacccggaacgaggatggtgatgaccacaactgctaactggctgtgggcattactgggcaagaagaaaaatccgcgcttgtgcacccgagaggagtttatatccaaggtacggagcaacgccgctattggtgccgttttccaggaagaacaggggtggacatctgcatcagaagccgtgaatgatagtagattttgggagctcgtcgacaaagaaagggctctgcaccaagagggaaagtgtgagtcctgcgtgtataacatgatgggcaaacgcgaaaagaagctaggcgagttcgggagagcgaaaggaagccgggccatctggtacatgtggcttggtgcaaggtttctggagttcgaggctctcggcttcctgaacgaagatcattggtttgggcgtgaaaattcttggtcgggagtggagggcgaaggtttgcaccgactggggtatatcctcgaggaaattgacaagaaagatggagaccttatgtacgccgatgacactgcaggctgggatacccgcataacggaggacgatctgcagaacgaggaattaatcacagagcagatggcccctcatcacaagattctggctaaagccatcttcaagttgacctatcagaataaggtcgttaaagtgctcagacccactccacggggcgcggtaatggacattatctcaaggaaggatcaacgcgggagcggacaggtgggtacatacggcctgaacacctttactaatatggaagtccagctaataagacagatggaggcagaaggggtgatcacccaagacgacatgcagaaccctaaaggacttaaggagcgggttgagaaatggctgagggaatgcggcgtggatcgactcaagcgtatggccatttccggtgacgattgtgtcgtgaaacccctggacgagagattcgggacaagtttgttatttctgaatgatatgggaaaggtacgcaaggacatcccacagtgggaaccctctaaaggctggaagaactggcaggaggttcctttctgcagccatcactttcacaaaattttcatgaaggatggccggtccctcgtggtcccatgtaggaatcaagacgaacttatcgggagagctcgcatatcacagggagccggttggagtctgcgggagacggcatgcctaggcaaggcttacgcccagatgtggtctctgatgtattttcataggcgagatctcagattggctagcatggccatttgttccgcagtgccgaccgagtggttccccacttcacggacaacctggagcatccacgcgcatcaccagtggatgactacagaagacatgctgaaggtttggaacagggtgtggatcgaggataatcctaacatgattgacaagaccccagtccactcttgggaagacataccctaccttgggaaacgcgaggatctgtggtgcggatccctcatcggcttaagtagccgtgccacgtgggctaagaatattcatacagccatcacccaagtgagaaacctgattggtaaagaagagtatgtagactacatgcctgtgatgaagcgatattcggcaccatccgagtctgaaggggtcttgtga

SEQ ID NO: 15707 - RNA, 9867 nt, synthetic construct
  misc_feature 1..9867: note = derived and/or modified CDS sequence (opt3) from DENV-4__GQ199879__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatggtaagaatcctcattggttttctggtcctttggatcgggactaattccaggaacaccagcatggcaatgacatgcattgccgtgggaggcataactttgttcctgggttttaccgttcaggctgacatgggctgtgtggtctcttggtcagggcgtgagctcaagtgcggaagtggcatcttcgtggttgataatgtgcatacgtggacagaacaatacaaatttcagcccgagagcccagcccggctggcatccgcgattcttaacgctcacaaggacggggtatgtggaatccgatctaccactagactggagaatgtcatgtggaaacagatcacaaacgaattgaattatgtgctctgggagggcggtcacgacctgaccgtggtcgccggggatgttaagggagtgttaactaaaggcaagagggcactgacccctcccgtatcggacctaaagtacagctggaaaacatggggtaaggccaaaattttcacgccagaagctcgcaactccacctttctcatagatggccccgacacttcagagtgccctaatgaacggagagcctggaacagtctggaggtggaggattacgggttcggaatgttcacaaccaatatctggatgaagtttagggaaggctctagcgaggtctgtgaccatcgccttatgtccgcagctattaaagatcagaaggccgtgcacgcggacatggggtattggatcgaatcaagcaaaaaccaaacatggcagattgagaaggcctctttgatcgaagttaagacttgcctgtggccaaaaacccatacgctctggtccaatggagtgctggagagtcagatgttaataccgaagagctacgctggccccttctctcagcacaactatcgacaaggttacgcaacacagaccgtcgggccttggcacctgggaaaacttgagatcgattttggcgaatgcccaggtactaccgtgacaattcaggaggactgtgatcatcggggcccctccttgcgtactaccacagcctcagggaagctcgttacgcagtggtgctgtagaagttgcaccatgcctccactgaggttcctaggagaagacggctgttggtatgggatggagatccgccccctgaacgagaaagaagagaatatggtgaagagccaagtcactgctggacagggcacatcggaaaccttttccatgggtctcctgtgccttactttgttcgtagaggaatgtctgcggagaagggtgacacgaaagcacatgattttagttgtggtcatcaccctctgcgccataattctggggggacttacgtggatggatctgttgcgcgcactcatcatgctgggcgacactatgtctggccggattgggggacagatccatctagcgataatggccgtgtttaaaatgagcccgggttacgtactgggcgtgttcctcagaaagctgacctcaagggagacagctcttatggtcatcgggatggccatgaccactgttttgagtattcctcacgacctgatggagttaatcgatggaatttccctcggcctgatccttctgaaaatagtgacacagtttgacaacacccaagtgggtacactagcactctctctgactttcattcgtagcaccatgccattggtcatggcttggcgcacgatcatggccgtgctgtttgttgtaacattaatccccctctgtcggacctcctgcctgcagaagcagtcacattgggtggaaattactgcacttatcctgggggcccaagctttgcctgtctatctcatgaccctgatgaaaggagcgagcagaaggagttggcccctaaatgagggcattatggccgtgggcctggtttctcttctcgggtccgcactgttgaagaacgatgtgccactggctggacctatggtcgccggtggcttactcctggccgcttacgtgatgagcgggtcgtcagcagacctttctctggaaaaggccgcgaatgtacagtgggatgagatggctgacataacaggaagttcccccatcattgaagtcaaacaggatgaggacggcagcttctctatccgagatgtggaggaaactaacatgattaccttgctcgttaagctggccctaatcacggtgagcggtctgtacccacttgcaataccggtcacaatgaccctctggtatatgtggcaggtgaaaactcaacggtccggggccctgtgggacgttccttcacccgctgcaacacagaaggccgcgttgagtgagggagtgtaccgcatcatgcagagaggcttatttggcaaaacccaggtcggggtgggaattcacatggaaggtgtattccacactatgtggcatgtgacaaggggcagcgttatctgtcacgagaccgggcggctggaaccatcttgggctgatgtccgaaatgacatgatttcctatggaggcggttggagactcggggataagtgggacaaggaggaggacgtgcaagtgctggccatcgaacccggaaaaaaccctaagcatgtccagacgaaaccaggccttttcaagactctgaccggcgagataggggcagtaacattggattttaaacccggaacctcaggtagtcctattatcaatcgcaagggcaaagtgatcgggctatacggaaacggcgttgtgacaaagagcggtgactatgtctccgccattactcaggctgaaaggataggggagccggattacgaggtggacgaagatatcttccgtaagaaacggctgaccattatggacctccacccaggagccggcaagacgaaaagaatcctgccctctattgttagggaggcacttaagcgccgattaagaacactgatcctcgctcctactcgggtggtcgccgcggaaatggaggaagccttgaggggcctgccaatacgctatcagacccccgcagtgaaatcggagcatacagggcgtgagatcgtagatctcatgtgccacgctacctttactaccagactgcttagctcaacacgggtgcctaattacaacctgattgttatggacgaagcccacttcacggatccgtccagtgtcgctgcaaggggatacatctctactcgcgtggagatgggtgaagccgccgctatttttatgaccgcgacacccccaggcgcaaccgaccctttcccccaaagcaattccccaatcgaggatatagaacgagagattcctgagagatcatggaacactgggtttgactggatcacagactatcagggaaagaccgtgtggttcgtcccctctatcaaggccggcaatgatattgctaactgcttgcggaaaagcggtaagaaagttatccagctaagtaggaagacgtttgacactgaatacccaaaaacaaagctgaccgattgggacttcgtggtaaccactgatatatccgagatgggggccaactttcgcgcaggcagagtgattgacccgaggcggtgtctcaagcctgtcatcttaacagatggacccgaacgtgtgattctggccggcccaatccccgttacccctgctagcgcggcccaacgccgagggagaataggaaggaatccagcacaggaggacgatcagtatgtgttctctggtgacccccttaaaaacgatgaagaccatgctcactggacagaggccaagatgctgctcgataatatttacactcctgagggcatcatcccgacgttgttcgggccagaacgggagaaaacccaggcaattgacggagaatttcgcctgagaggcgagcaaaggaagacattcgtcgagctcatgcggcgaggtgacctgcccgtatggctttcatataaagtggcctccgctgggatcagttacaaggatagagaatggtgctttactggcgagcgcaacaatcagattctagaagagaacatggaagttgagatatggaccagggagggagaaaagaaaaagctgcggcctcgttggttggacgccagagtgtatgcggatcccatggcattaaaagacttcaaggagtttgccagcggcaggaaatcgatcacactggatattctcaccgaaatcgcttctctgccaacttacctttccagccgcgccaagctggctctcgacaatatcgtcatgttgcatacgaccgagcgggggggacgagcataccagcacgccctgaacgaactacctgagtcactggagacactcatgcttgtggctctgttaggtgccatgactgcaggcattttcttgtttttcatgcaggggaagggaataggcaaactgagtatgggtctcatcgcgattgccgtcgcttctgggctgctttgggtggccgaaatccaaccccagtggattgcagcttccatcatactggagtttttcctcatggttttgctgatcccagaacctgagaagcagagaaccccgcaggataatcaattaatttatgtgatcctaacaattctgaccatcataggcctcattgccgcaaacgaaatgggacttatcgagaaaactaagacagactttggcttctaccaggtaaaaacggagaccactattctggatgtggacttgaggcccgccagcgcttggacactgtatgcggtcgccaccaccatcctcacaccaatgctgcgccacactatagaaaatacgtcagcaaaccttagtctcgctgccatcgccaatcaggcagctgttctgatggggttgggaaagggctggcctctgcatcggatggatttaggtgtgcccctactggccatggggtgttacagccaggtcaacccaaccacactcactgcgtcccttgtgatgctgttggtacactatgctattatcggacctggcctgcaagccaaagcaaccagagaggcccagaagcgtacagctgcaggtattatgaagaatcccaccgtggacggcatcactgttatagatctcgaaccgatttcttacgacccaaaatttgagaagcagctggggcaagtgatgcttttagtcctgtgcgccggacagctcttgctgatgaggacgacatgggcgttctgtgaggtgctaaccctggctactggccctatcctcaccctttgggaagggaaccccggacggttctggaacacaactatcgccgtcagcaccgcaaatatttttcgcggctcctatctggccggtgctgggttggccttctcactgatcaaaaacgcacagacaccacgaagaggaacgggcaccactggtgagacactcggcgaaaagtggaaaaggcagctgaattctttagaccggaaggagtttgaagagtacaagcgcagtgggatacttgaggtggatagaaccgaagctaaatcggccctgaaggacggaagcaaaactaagcatgcggtttccaggggctcttcaaaaattcgatggatcgtagagcgggggatggtgaagcccaagggaaaagtcgtggatctcggctgcggtcgtgggggatggagctactatatggccacactaaagaacgttaccgaagtgaaaggctacacgaagggcgggcctggacacgaggaaccgattcccatggcaacctatggttggaatctggtcaaattgcattccggcgtggacgtattctacaagccaacagagcaagtggatactctgctctgtgacatcggggagagttctagcaaccctaccatagaagagggaagaacacttcgcgttctgaagatggtcgaaccctggttgtcatccaaacctgagttttgcatcaaggtgctgaatccatatatgcccactgtgattgaagagctcgagaaattacagaggaagcacggcggtaacctggtccggtgtcctcttagtagaaatagcacccacgaaatgtactgggtttctggggcttccggaaacatcgtgtcaagcgtaaatacaacctcgaaaatgctgctaaaccgcttcactacgaggcatcgaaagccaacatatgagaaagatgtggacctcggcgccggcacccggtctgtcagtactgaaaccgagaagcccgatatgacaattatcgggagaaggctgcagcgcttgcaggaggaacacaaggagacgtggcattacgaccaagaaaatccgtaccgtacctgggcatatcacggatcctacgaggctcctagcactggttcagcctcctctatggtgaacggcgttgtgaaactgctcacaaagccatgggatgtcattcccatggtgacccagcttgccatgactgacacaaccccttttgggcagcagcgggtattcaaagaaaaggttgacacaagaactccacaacccaaaccgggaaccaggatgatcatgacgaccacagcgaattggctgtgggctttactgggcaagaagaaaaaccctcgcttgtgcactcgagaggagtttataagcaaggtgcggagtaatgcagccattggtgctgtcttccaggaagagcaggggtggacctccgccagcgaagcagtgaacgattctagattttgggagctcgtggacaaagaaagggccctgcaccaagagggaaagtgtgagtcatgcgtctataacatgatgggcaaacgcgaaaagaagctaggcgagttcgggagagctaaaggaagtcgggcgatctggtacatgtggcttggtgccaggtttctggaattcgaggcactcggcttcctgaatgaagatcattggtttgggcgtgagaactcctggagcggagttgagggcgaaggtttgcaccgactggggtatatcctcgaggaaattgacaagaaagatggagaccttatgtacgctgatgacacagccggctgggatactcgcataaccgaggacgatctgcagaatgaggaattaatcacggagcagatggcaccccatcacaagattctggccaaagctatcttcaagttgacatatcagaacaaggtggtaaaagtgctcagaccaacccctcggggcgccgtcatggacattatctctaggaaggatcaacgcgggtcgggacaggtgggtacttacggcctgaatacatttaccaacatggaagttcagctaataagacagatggaggcggaaggggtgatcactcaagacgacatgcagaatcccaaaggacttaaggagcgggtcgagaaatggctgagggaatgcggcgtggatcgactcaagcgtatggcaatttcaggtgacgattgtgtagttaaaccactggacgagagattcgggaccagcttgttatttctgaacgatatgggaaaggtgcgcaaggacatcccccagtgggaaccttccaaaggctggaagaattggcaggaggtcccattctgcagtcatcactttcacaaaattttcatgaaggatggccggtctctcgtggttccgtgtaggaaccaagacgaacttatcgggagagcccgcataagccagggagctggttggtccctgcgggagacagcctgcctaggcaaagcatacgctcagatgtggtcactgatgtattttcataggcgagatctcagattggccagtatggctatttgttctgccgtgcccacggagtggttccctaccagccggactacatggtccatccacgcacatcaccagtggatgaccactgaagacatgctgaaggtctggaatagggtgtggatcgaggataacccaaatatgacagacaagacccccattcactcatgggaagacataccttaccttgggaaacgcgaggatctgtggtgcggaagcctcatcggcttatcttcccgtgcgacgtgggccaagaacattcatacagctatcacccaagtaagaaatctgattggtaaagaagagtatgtggactacatgccagtcatgaagcgatatagtgcccccagcgagtcggaaggggttttgtga

SEQ ID NO: 15708 - RNA, 9867 nt, synthetic construct
  misc_feature 1..9867: note = derived and/or modified CDS sequence (opt3) from DENV-4__GQ199880__SS-prME
  source 1..9867: mol_type = other RNA
agcaccataacactgctctgccttattcccactgtgatggccttccacctgtccacgagagacggcgagcctttgatgatagtcgctaagcatgaaagggggcggccgttactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactgactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctcatcggttttctggtactttggattgggactaattccagaaacaccagcatggcaatgacatgcatagccgtcggaggcatcactttgttcctgggttttaccgtgcaggctgacatgggctgtgttgtgtcttggtcagggcgtgagctcaagtgcggaagtggcattttcgtcgtggataatgttcatacgtggacagaacaatacaaatttcagcccgagagcccagcccggctggcatccgcgatccttaacgctcacaaggacggggtgtgtggaatccgatctaccactagactggagaatgtaatgtggaaacagattacaaacgaattgaattatgtcctctgggagggcggtcacgacctgaccgtggtggccggggatgtcaagggagttttaactaaaggcaagagggcactgacccctcccgtgtcggacctaaagtacagctggaaaacatggggtaaggccaaaatattcacgccagaagctcgcaactccacctttctcatcgatggccccgacacttcagagtgccctaatgaacggagagcctggaacagtctggaggtagaggattacgggttcggaatgttcacaaccaatatttggatgaagtttagggaaggctctagcgaggtgtgtgaccatcgccttatgtccgcagctatcaaagatcagaaggccgtccacgcggacatggggtattggattgaatcaagcaaaaaccaaacatggcagatcgagaaggcctctttgatagaagtgaagacttgcctgtggccaaaaacccatacgctctggtccaatggagttctggagagtcagatgttaatcccaaagagctacgctggccccttctctcagcacaactatcgacaaggttacgcaacacagaccgtggggccttggcacctgggaaaacttgagattgattttggcgaatgcccaggtactaccgtcacaatccaggaggactgtgatcatcggggcccctccttgcgtactaccacagcctcagggaagctcgtgacgcagtggtgctgtagaagttgcaccatgcctccactgaggttcctaggagaagacggctgttggtatgggatggagattcgccccctgaacgagaaagaagagaatatggttaagagccaagtgactgctggacagggcacatcggaaaccttttccatgggtctcctgtgccttactttgttcgtcgaggaatgtctgcggagaagggtaacacgaaagcacatgatcttagtggttgtgataaccctctgcgccattatcctagggggccttacgtggatggatctgttgcgcgcactcattatgctgggcgacactatgtctggccggatcgggggacagatacatctagcgatcatggccgtctttaaaatgagcccgggttacgtgctgggcgtattcctcagaaagctgacctcaagggagacagctcttatggtgattgggatggccatgaccactgtcttgagtatccctcacgacctgatggagttaattgatggaatctccctcggcctgatacttctgaaaattgttacacagtttgacaacacccaagtgggtacactagcactctctctgactttcatccgtagcaccatgccattggtgatggcttggcgcacgatcatggccgtcctgtttgtggttacattaattcccctctgtcggacctcctgcctgcagaagcagtcacattgggtagaaatcactgcacttattctgggggcccaggctttgcctgtgtatctcatgaccctgatgaaaggagcgagcagaaggagttggcccctaaatgagggcataatggccgtcggcctggtgtctcttctcgggtccgcactgttgaagaacgatgttccactggctggacctatggtggccggtggcttactcctggccgcttacgtcatgagcgggtcgtcagcagacctttctctggaaaaggccgcgaatgtgcagtgggatgagatggctgacatcacaggaagttcccccattatcgaagtaaaacaggatgaggacggcagcttctctattcgagatgtcgaggaaactaacatgatcaccttgctcgtgaagctggccctaataacggttagcggtctgtacccacttgcaatcccggtgacaatgaccctctggtatatgtggcaggtcaaaactcaacggtccggggccctgtgggacgtgccttcacccgctgcaacacagaaggccgcgttgagtgagggagtttaccgcattatgcagagaggcttatttggcaaaacccaggtgggggtcggaatccacatggaaggtgtgttccacactatgtggcatgtaacaaggggcagcgtgatttgtcacgagaccgggcggctggaaccatcttgggctgatgttcgaaatgacatgatctcctatggaggcggttggagactcggggataagtgggacaaggaggaggacgtccaagtgctggccatagaacccggcaaaaaccctaagcatgtgcagacgaaaccaggccttttcaagactctgaccggcgagattggggcagtcacattggattttaaacccggaacctcaggtagtcctatcatcaatcgcaagggcaaagtaattgggctatacggaaacggcgtggttacaaagagcggtgactatgtgtccgccataactcaggctgaaaggatcggggagccggattacgaggtcgacgaagatattttccgtaagaaacggctgaccatcatggacctccacccaggagccggcaagacgaaacggattctgccctctatcgtgagggaggcacttaagcgccgattaagaacactgatactcgctcctactcgggttgtggccgcggaaatggaggaagccttgaggggcctgccaatccgctatcagacccccgcagtcaaatcggagcatacagggcgtgagattgtggatctcatgtgccacgctacctttactaccagactgcttagctcaacacgggtacctaattacaacctgatcgtgatggacgaagcccacttcacggatccgtccagtgttgctgcaaggggatacatttctactcgcgtcgagatgggtgaagccgccgctatctttatgaccgcgacacccccaggcgcaaccgaccctttcccccaaagcaattccccaatagaggatattgaacgagagatccctgagagatcatggaacactgggtttgactggatcacagactatcagggaaagaccgtgtggttcgtgccctctattaaggccggcaatgatatcgctaactgcttgcggaaaagcggtaagaaagtcatacagctaagtaggaagacgtttgacactgaatacccaaaaacaaagctgaccgattgggacttcgttgtgaccactgatatttccgagatgggggccaactttcgcgcaggcagagtaatcgacccgaggcggtgtctcaagcctgtgattttaacagatggacccgaacgtgtcatcctggccggcccaatacccgtgacccctgctagcgcggcccaacgccgagggagaattggaaggaatccagcacaggaggacgatcagtatgttttctctggtgacccccttaaaaacgatgaagaccatgctcactggacagaggccaagatgctgctcgataatatctacactcctgagggcatcattccgacgttgttcgggccagaacgggagaaaacccaggcaatcgacggagaatttcgcctgagaggcgagcaaaggaagacattcgtggagctcatgcggcgaggtgacctgcccgtctggctttcatataaagtagcctccgctgggattagttacaaggatagagaatggtgctttactggcgagcgcaacaatcagatactagaagagaacatggaagtggagatctggaccagggagggagaaaagaaaaagctgcggcctcgttggttggacgccagagtttatgcggatcccatggcattaaaagacttcaaggagtttgccagcggcaggaaatcgattacactggatatcctcaccgaaatcgcttctctgccaacttacctttccagccgcgccaagctggctctcgacaatattgtgatgttgcatacgaccgagagagggggacgagcataccagcacgccctgaacgaactacctgagtcactggagacactcatgcttgtcgctctgttaggtgccatgactgcaggcatattcttgtttttcatgcaggggaagggaatcggcaaactgagtatgggtctcattgcgatcgccgtggcttctgggctgctttgggtcgccgaaattcaaccccagtggatcgcagcttccataatcctggagtttttcctcatggtgttgctgattccagaacctgagaagcagagaaccccgcaggataatcaattaatctatgttattctaacaatcctgaccataattggcctcatcgccgcaaacgaaatgggacttattgagaaaactaagacagactttggcttctaccaggtgaaaacggagaccactatcctggatgtagacttgaggcccgccagcgcttggacactgtatgcggtggccaccaccatactcacaccaatgctgcgccacactatcgaaaatacgtcagcaaaccttagtctcgctgccattgccaatcaggcagctgtcctgatggggttgggaaagggctggcctctgcatcggatggatttaggtgttcccctactggccatggggtgttacagccaggtgaacccaaccacactcactgcgtcccttgtcatgctgttggtgcactatgctatcattggacctggcctgcaagccaaagcaaccagagaggcccagaagcgtacagctgcaggtatcatgaagaatcccaccgtagacggcataactgtgattgatctcgaaccgatctcttacgacccaaaatttgagaagcagctggggcaagttatgcttttagtgctgtgcgccggacagctcttgctgatgaggacgacatgggcgttctgtgaggtcctaaccctggctactggccctatcctcaccctttgggaagggaaccccggacggttctggaacacaactattgccgtgagcaccgcaaatatctttcgcggctcctatctggccggtgctgggttggccttctcactgatcaaaaacgcacagacaccacgaagaggaacgggcaccactggtgagacactcggcgaaaagtggaaaaggcagctaaattctttagaccggaaggagtttgaagagtacaagcgcagtgggattcttgaggtcgatagaaccgaagctaaatcggccctgaaggacggaagcaaaactaagcatgcggtgtccaggggatcttcaaaaatccgatggattgttgagcgggggatggtaaagcccaagggaaaagtggtcgatctcggctgcggtcgtgggggatggagctactatatggccacactaaagaacgtgaccgaagttaaaggctacacgaagggcgggcctggacacgaggaaccgatccccatggcaacctatggttggaatctggtgaaattgcattccggcgtcgacgtgttctacaagccaacagagcaagtagatactctgctctgtgacataggggagagttctagcaaccctaccatcgaagagggaagaacacttcgcgtgctgaagatggttgaaccctggttgtcatccaaacctgagttttgcattaaggtcctgaatccatatatgcccactgtgatcgaagaactcgagaaattacagaggaagcacggcggtaacctggtgcggtgtcctcttagtagaaatagcacccacgaaatgtactgggtctctggggcttccggaaacattgtttcaagcgtgaatacaacctcgaaaatgctgctaaaccgcttcactacgaggcatcgaaagccaacatatgagaaagatgtagacctcggcgccggcacccggtctgtgagtactgaaaccgagaagcccgatatgacaatcattgggagaaggctgcagcgcttgcaggaggaacacaaggagacgtggcattacgaccaagaaaatccgtaccgtacctgggcatatcacggatcctacgaggctcctagcactggttcagcctcctctatggtcaacggcgtggttaaactgctcacaaagccatgggatgtgatccccatggtcacccagcttgccatgactgacacaaccccttttgggcagcagcgggtgttcaaagaaaaggtagacacaagaactccacaacccaaaccgggaaccaggatgataatgacgaccacagcgaattggctgtgggctttactgggcaagaagaaaaaccctcgcttgtgcactcgagaggagtttattagcaaggttcggagtaatgcagccatcggtgctgtgttccaggaggaacaagggtggacctccgccagcgaagcagtcaacgattctagattttgggagctcgtggacaaagaaagggccctgcaccaagagggaaagtgtgagtcatgcgtgtataacatgatgggcaaacgcgaaaagaagctaggcgagttcgggagagctaaaggaagtcgggcgatctggtacatgtggcttggtgccaggtttctggagttcgaggcactcggcttcctgaatgaagatcattggtttgggcgtgagaactcctggagcggagtcgagggcgaaggtttgcaccgactggggtatattctcgaggaaatagacaagaaagatggagaccttatgtacgctgatgacacagccggctgggatactcgcatcaccgaggacgatctgcagaatgaggaattaattacggagcagatggcaccccatcacaagatcctggccaaagctattttcaagttgacatatcagaacaaggttgtgaaagtactcagaccaacccctcggggcgccgtgatggacatcatatctaggaaggatcaacgcgggtcgggacaggtcggtacttacggcctgaatacatttaccaacatggaagtgcagctaatcagacagatggaggcggaaggggttattactcaagacgacatgcagaatcccaaaggacttaaggagcgggtggagaaatggctgagggaatgcggcgtcgatcgactcaagcgtatggcaatctcaggtgacgattgtgtggtaaaaccactggacgagagattcgggaccagcttgttatttctgaacgatatgggaaaggttcgcaaggacattccccagtgggaaccttccaaaggctggaagaattggcaggaggtgccattctgcagtcatcactttcacaaaatcttcatgaaggatggccggtctctcgtcgtgccgtgtaggaaccaagacgaacttatagggagagcccgcattagccagggagctggttggtccctgcgggagacagcctgcctaggcaaagcatacgctcagatgtggtcactgatgtattttcataggcgagatctcagattggccagtatggctatctgttctgccgttcccacggagtggttccctaccagccggactacatggtccatccacgcacatcaccagtggatgaccactgaagacatgctgaaggtgtggaatagggtctggattgaggataacccaaatatgacagacaagacccccatacactcatgggaagacatcccttaccttgggaaacgcgaggatctgtggtgcggaagcctcattggcttatcttcccgtgcgacgtgggccaagaacatccatacagctattacccaagtgagaaatctgatcggtaaagaagagtatgtagactacatgccagtgatgaagcgatatagtgcccccagcgagtcggaaggggtcttgtga

SEQ ID NO: 15709 - RNA, 9867 nt, synthetic construct
  misc_feature 1..9867: note = derived and/or modified CDS sequence (opt3) from DENV-4__GQ252675__SS-prME
  source 1..9867: mol_type = other RNA
agcaccatcaccctgctctgccttattcccactgtgatggccttccacctgtccacgagagacggagagcctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtgatgtatggaacctgcacgcagtcaggggagcgccgacgtgaaaagcggagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactgactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaagatccggatggaaaaacttcgaatcaagggtatgagttatactatgtgctctgggaaattctccattgacaaggagatggccgagacacaacacggcacgaccgtagtcaaagtgaagtacgaaggagcaggcgccccttgtaaggttccaatagagatccgcgatgtgaataaagaaaaggtcgtggggagagtaattagctcgactcccctggctgagaacacaaactctgtgaccaatatcgagttggaaccgcctttcggagactcctatatagttattggtgtcggcaactcagcgctcacactgcattggtttaggaaagggagtagcatcggaaagatgttcgagtccacttaccggggcgcaaaacgcatggccatcttaggtgaaaccgcttgggattttgggtctgtgggcggactgttcacgagcctaggcaaggccgtgcaccaggtctttgggtcagtttataccacaatgttcggaggcgtgagttggatgattagaatcctcattggttttctggtgctttggatagggactaattccaggaacaccagcatggcaatgacatgcatcgccgtaggaggcattactttgttcctgggttttaccgtccaggctgacatgggctgtgtggtttcttggtcagggcgtgagctcaagtgcggaagtggcatcttcgtggtcgataatgtgcatacgtggacagaacaatacaaatttcagcccgagagcccagcccggctggcatccgcgatccttaacgctcacaaggacggggtttgtggcattcgatctaccactagactggagaatgtgatgtggaaacagataacaaacgaattgaattatgtactctgggagggcggtcacgacctgaccgtcgtggccggggatgtgaagggagtcttaactaaaggcaagagggcactgacccctcccgtttcggacctaaagtacagctggaaaacatggggtaaggccaaaatcttcacgccagaagctcgcaactccacctttctcattgatggccccgacacttcagagtgccctaatgaacggagagcctggaacagtctggaggtggaggattacgggttcggaatgttcacaaccaatatctggatgaagtttagggaaggctctagcgaggtatgtgaccatcgccttatgtccgcagctattaaagatcagaaggccgtgcacgcggacatggggtattggatcgaatcaagcaaaaaccaaacatggcagatagagaaggcctctttgatcgaagtcaagacttgcctgtggccaaaaacccatacgctctggtccaatggagtgctggagagtcagatgttaattccaaagagctacgctggccccttctctcagcacaactatcgacaaggttacgcaacacagaccgttgggccttggcacctgggaaaacttgagatcgattttggcgaatgcccaggtactaccgtgacaattcaggaggactgtgatcatcggggcccctccttgcgtactaccacagcctcagggaagctcgtcacgcagtggtgctgtagaagttgcaccatgcctccactgaggttcctaggagaagacggctgttggtatgggatggagatccgccccctgaacgagaaagaagagaatatggtaaagagccaagttactgctggacagggcacatcggaaaccttttccatgggtctcctgtgccttactttgttcgtggaggaatgtctgcggagaagggtcacacgaaagcacatgatgttagtagtggttataaccctctgcgccattatcctagggggacttacgtggatggatctgttgcgcgcactcattatgctgggcgacactatgtctggccggatcgggggacagatacatctagcgatcatggccgtgtttaaaatgagcccgggttacgtcctgggcgtgttcctcagaaagctgacctcaagggagacagctcttatggtaattgggatggccatgaccactgtgttgagtatccctcacgacctgatggagttaattgatggaatctccctcggcctgatacttctgaaaacagtcacccagtttgacaacacacaagttggtactctagcactctctctgaccttcattcgtagcacgatgccattggtgatggcttggcgcacaatcatggccgtgctgtttgtcgtgaccttaatccccctctgtcggacttcctgcctgcagaagcagtcacattgggttgaaattaccgcacttatcctgggggcccaggctttgcctgtatatctcatgacactgatgaaaggagcgagcagaaggagttggcccctaaatgagggcattatggccgtgggcctggtctctcttctcgggtccgcactgttgaagaacgatgtgccactggctggacctatggttgccggtggcttactcctggccgcttacgtgatgagcgggtcgtcagcagacctttctctggaaaaggccgcgaatgtccagtgggatgagatggctgacataactggaagttcccccatcattgaagtgaaacaggatgaggacggcagcttctctatccgagatgtagaggaaaccaacatgattacgttgctcgtcaagctggccctaatcacagtgagcggtctgtacccacttgcaataccggttaccatgactctctggtatatgtggcaagtgaaaacacaacggtccggggccctgtgggacgtcccttcacccgctgcaacccagaaggccgcgttgagtgagggagtgtaccgcatcatgcagagaggcttatttggcaaaactcaggttggggtgggcattcacatggaaggtgtcttccacacaatgtggcatgtgaccaggggcagcgtaatctgtcacgagacggggcggctggaaccatcttgggctgatgtgcgaaatgacatgatttcctatggaggcggttggagactcggggataagtgggacaaggaggaggacgttcaagtcctggccatcgaacccggcaaaaaccctaagcatgtgcagactaaaccaggccttttcaagaccctgacaggcgagataggggcagtgaccttggattttaaacccggaacatcaggtagtcctattatcaataagaaaggcaaggtcatcgggctatacggaaacggcgtagtgactaagagcggtgactatgtttccgccattacccaggctgaacgcataggggagccggattacgaggtggacgaagatatcttcaggaaaaagcgtctgacgattatggacctccacccaggagccggcaaaacaaagcggatcctgccctctattgtcagagaggcacttaaaaggcgcttacgaactctgatcctcgctcctaccagagtggttgccgcggaaatggaggaagccttgcggggcctgccaataaggtatcagacacccgcagtgaagtcggagcataccgggcgcgagatcgtcgatctcatgtgccacgctacttttaccacacgtctgcttagctcaacgagagtgcctaattacaacctgattgtaatggacgaagcccacttcactgatccgtccagtgtggctgcacggggatacatctctaccagggttgagatgggtgaagccgccgctatttttatgacagcgacacccccgggcgcaactgaccctttcccccaaagcaattccccaatcgaggatatagaacgcgagattcctgagcgatcatggaacacagggtttgactggatcaccgactatcagggaaagacggtctggttcgtgccctctatcaaagccggcaatgatattgctaactgcttgagaaagagcggtaaaaaggtgatccagctaagtcggaaaacttttgacacagaatacccaaagaccaagctgaccgattgggacttcgtcgttactacagatatatccgagatgggggccaactttagggcaggccgcgtgattgacccgagaaggtgtctcaaacctgtaatcttaaccgatggacccgaacgggtgattctggccggcccaatccccgtcactcctgctagcgcggcccaacgtcgcgggcgaataggaagaaatccagcacaggaggacgatcagtatgtgttctctggtgacccccttaagaacgatgaagaccatgctcactggacagaggccaaaatgctgctcgataatatttacacgcctgagggcatcatcccgaccttgttcgggccagaaagggagaagacacaggcaattgacggagaatttcggctgcgcggcgagcaaagaaaaactttcgttgagctcatgaggcggggtgacctgcccgtgtggctttcatataaggtcgcctccgctgggatcagttacaaggatcgagaatggtgctttaccggcgagagaaacaatcagattctagaagagaacatggaagtagagatatggacacgcgagggagagaaaaagaaactgaggcctcggtggttggacgcccgtgtgtatgcggatcccatggcattaaaggacttcaaagagtttgccagcggcagaaagtcgatcaccctggatattctcactgaaatcgcttctctgccaacgtacctttccagcagggccaagctggctctcgacaatatcgttatgttgcataccacagagcgcgggggacgggcataccagcacgccctgaacgaactacctgagtcactggagactctcatgcttgtggctctgttaggtgccatgaccgcaggcattttcttgtttttcatgcaggggaaaggaataggcaagctgagtatgggtctcatcgcgattgccgtcgcttctgggctgctttgggtggccgaaatccaaccccagtggattgcagcttccatcatactggagtttttcctcatggtcttgctgatcccagaacctgagaaacagcgaacaccgcaggataatcaattaatttatgtgatcctaaccattctgactatcataggcctcattgccgcaaacgaaatgggacttatcgagaagacaaaaacggactttggcttctaccaggttaagaccgagactacaattctggatgtggacttgagacccgccagcgcttggaccctgtatgcggtagccaccacaatcctcactccaatgctgaggcacacgatagaaaatacctcagcaaaccttagtctcgctgccatcgccaatcaggcagctgtgctgatggggttgggaaaaggctggcctctgcatcgcatggatttaggtgtccccctactggccatggggtgttacagccaggttaacccaacaactctcaccgcgtcccttgtgatgctgttggtccactatgctattatcggacctggcctgcaagccaaggcaacacgggaggcccagaagagaaccgctgcaggtattatgaaaaatcccactgtggacggcatcacggtaatagatctcgaaccgatttcttacgacccaaagtttgagaaacagctggggcaagtgatgcttttagttctgtgcgccggacagctcttgctgatgcgtacaacctgggcgttctgtgaggtgctaactctggctaccggccctatcctcacactttgggaagggaaccccggaaggttctggaacactaccatcgccgtcagcacagcaaatatttttcggggctcctatctggccggtgctgggttggccttctcactgatcaagaacgcacagacgccacgccgaggaaccggcactacaggtgagaccctcggcgaaaaatggaagagacagctaaattctttagacaggaaggagtttgaagagtacaaacggagtgggatacttgaggtggatcgcactgaagctaagtcggccctgaaagacggaagcaagacaaaacatgcggtctccagaggatcttcaaagattaggtggatcgtggagcgagggatggttaagcccaaaggaaaggtagtggatctcggctgcggtagagggggatggagctactatatggccaccctcaaaaacgtcacggaagtgaagggctacaccaaaggcgggcctggacacgaggaaccgattcccatggcaacatatggttggaatctggttaagttgcattccggcgtggacgtcttctacaagccaactgagcaagtggataccctgctctgtgacatcggggagagttctagcaaccctacaatagaagagggacgtactcttagagtactgaaaatggtggaaccctggttgtcatccaagcctgagttttgcatcaaagttctgaatccatatatgcccaccgtcattgaagaactagagaagttacagcgcaaacacggcggtaacctggtgaggtgtcctcttagtcggaatagcacacacgaaatgtactgggtgtctggggcttccggaaacatcgtctcaagcgttaataccacttcgaagatgctgctaaacagattcacgacacgccataggaaaccaacctatgagaaggatgtggacctcggcgccggcactcgatctgtaagtaccgaaacagagaagcccgatatgacgattatcgggcggagactgcagaggttgcaggaggaacacaaagagacctggcattacgaccaagaaaatccgtaccgcacttgggcatatcacggatcctacgaggctcctagcacaggttcagcctcctctatggtgaacggcgtcgtgaagctgctcaccaaaccatgggatgttattcccatggtgactcagcttgccatgacagacaccacaccttttgggcagcagcgtgtcttcaaggaaaaagtggacactcggaccccacaacccaagccgggaacgagaatgatcatgaccacaactgcgaattggctgtgggctttactgggcaagaaaaagaaccctaggttgtgcacccgcgaggagtttataagcaaagtacgaagtaatgcagccattggtgctgttttccaggaagaacaggggtggacatccgccagcgaagcagtgaacgattctcggttttgggagctcgtcgacaaggaaagagccctgcaccaagagggaaaatgtgagtcatgcgtgtataacatgatgggcaagagggaaaagaaactaggcgagttcgggcgcgctaagggaagtagagcgatctggtacatgtggcttggtgcccggtttctggagttcgaggcactcggcttcctgaatgaagatcattggtttgggagggagaactcctggagcggagtggagggcgaaggtttgcaccgtctggggtatatcctcgaggaaattgacaaaaaggatggagaccttatgtacgctgatgacactgccggctgggatacccgaataacggaggacgatctgcagaatgaggaattaatcacagagcagatggcaccccatcacaaaattctggccaaggctatcttcaagttgacctatcagaacaaagtcgttaaggtgctccgcccaactcctagaggcgccgtaatggacattatctctcggaaagatcaaagggggtcgggacaggtgggtacatacggcctgaatacctttactaacatggaagtccagctaatacgccagatggaggcggaaggggtgatcacccaagacgacatgcagaatcccaagggacttaaagagagagttgagaagtggctgcgggaatgcggcgtggataggctcaaacgaatggcaatttcaggtgacgattgtgtcgtgaagccactggacgagcgtttcgggacgagcttgttatttctgaacgatatgggaaaggtaagaaaagacatcccccagtgggaaccttccaagggctggaaaaattggcaggaggttccattctgcagtcatcactttcacaagattttcatgaaagatggccgctctctcgtggtcccgtgtcggaaccaagacgaacttatcgggagggccagaataagccagggagctggttggtccctgcgcgagacagcctgcctaggcaaggcatacgctcagatgtggtcactgatgtattttcatcggagggatctccgattggccagtatggctatttgttctgccgtgcccaccgagtggttccctactagcagaacaacctggtccatccacgcacatcaccagtggatgactacagaagacatgctgaaggtttggaatcgggtgtggatcgaggataacccaaatatgaccgacaaaacgcccattcactcatgggaagacataccttaccttgggaagagggaggatctgtggtgcggaagcctcatcggcttatcttcccgcgcgacatgggccaaaaacattcataccgctatcactcaagtccgtaatctgattggtaaggaagagtatgtggactacatgccagtaatgaaaagatatagtgcccccagcgagtcggaaggggtgttgtga

SEQ ID NO: 15710 - RNA, 9867 nt, synthetic construct
  misc_feature 1..9867: note = derived and/or modified CDS sequence (opt3) from DENV-4__FJ810417__SS-prME
  source 1..9867: mol_type = other RNA
agcaccatcaccctgctctgccttattcccactgtgatggccttccacctgtccacgagagacggagagcctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagcggagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactgactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgattcccctggctgagaacactaactctgttacaaatatcgagttggaaccgcctttcggagactcctatatagtcattggtgtgggcaactcagcgctcaccctgcattggtttaggaaagggagtagcatcggaaagatgttcgagtccacataccggggcgcaaaacgcatggccatcttaggtgaaactgcttgggattttgggtctgtgggcggactgttcaccagcctaggcaaggccgtccaccaggtttttgggtcagtgtatacgaccatgttcggaggcgtgagttggatgattagaatcctcattggttttctggtactttggatagggacaaattccaggaacactagcatggcaatgacctgcatcgccgtcggaggcattacattgttcctgggttttactgtgcaggctgacatgggctgtgttgtgtcttggtcagggcgtgagctcaagtgcggaagtggcatcttcgtcgtggataatgttcatacctggacggaacaatacaaatttcagcccgagagcccagcccggctggcatccgcgatccttaacgctcacaaggacggggtgtgtggcattcgatctacaaccagactggagaatgtaatgtggaaacagataactaacgaattgaattatgtcctctgggagggcggtcacgacctgacagtggtggccggggatgtcaagggagttttaaccaaaggcaagagggcactgactcctcccgtgtcggacctaaagtacagctggaaaacctggggtaaggccaaaatcttcacaccagaagctcgcaactccacgtttctcattgatggccccgacacctcagagtgccctaatgaacggagagcctggaacagtctggaggtagaggattacgggttcggaatgttcactacaaatatctggatgaagtttagggaaggctctagcgaggtgtgtgaccatcgccttatgtccgcagctattaaagatcagaaggccgtccacgcggacatggggtattggatcgaatcaagcaaaaaccaaacctggcagatagagaaggcctctttgatcgaagtgaagacatgcctgtggccaaaaactcataccctctggtccaatggagttctggagagtcagatgttaattccaaagagctacgctggccccttctctcagcacaactatcgacaaggttacgcaacgcagacagtggggccttggcacctgggaaaacttgagatcgattttggcgaatgcccaggtaccactgtcaccattcaggaggactgtgatcatcggggcccctccttgcgtacaactaccgcctcagggaagctcgtgacacagtggtgctgtagaagttgcacgatgcctccactgaggttcctaggagaagacggctgttggtatgggatggagatccgccccctgaacgagaaagaagagaatatggttaagagccaagtgaccgctggacagggcacttcggaaacattttccatgggtctcctgtgccttaccttgttcgtcgaggaatgtctgcggagaagggtaactcgaaagcacatgatattagtggttgtgattacactctgcgccatcattctagggggacttacctggatggatctgttgcgcgcactcatcatgctgggcgacacgatgtctggccggatagggggacagatccatctagcgattatggccgtctttaaaatgagcccgggttacgtgctgggcgtattcctcagaaagctgacttcaagggagaccgctcttatggtgatcgggatggccatgacaaccgtcttgagtattcctcacgacctgatggagttaatcgatggaatatccctcggcctgattcttctgaaaatcgttactcagtttgacaacacacaagtgggtaccctagcactctctctgacattcatccgtagcactatgccattggtgatggcttggcgcaccattatggccgtcctgtttgtggttacgttaatccccctctgtcggacatcctgcctgcagaagcagtcacattgggtagaaattaccgcacttatactgggggcccaggctttgcctgtgtatctcatgactctgatgaaaggagcgagcagaaggagttggcccctaaatgagggcatcatggccgtcggcctggtgtctcttctcgggtccgcactgttgaagaacgatgttccactggctggacctatggtggccggtggcttactcctggccgcttacgtcatgagcgggtcgtcagcagacctttctctggaaaaggccgcgaatgtgcagtgggatgagatggctgacattaccggaagttcccccatcattgaagtaaaacaggatgaggacggcagcttctctatccgagatgtcgaggaaacaaacatgataactttgctcgtgaagctggccctaatcaccgttagcggtctgtacccacttgcaattccggtgacgatgacactctggtatatgtggcaggtcaaaacccaacggtccggggccctgtgggacgtgccttcacccgctgcaactcagaaggccgcgttgagtgagggagtttaccgcatcatgcagagaggcttatttggcaaaacacaggtgggggtcggcattcacatggaaggtgtgttccacaccatgtggcatgtaactaggggcagcgtgatctgtcacgagacagggcggctggaaccatcttgggctgatgttcgaaatgacatgatatcctatggaggcggttggagactcggggataagtgggacaaggaggaggacgtccaagtgctggccattgaacccggcaaaaaccctaagcatgtgcagaccaaaccaggccttttcaagacgctgactggcgagatcggggcagtcaccttggattttaaacccggaacatcaggtagtcctatcattaatcgcaagggcaaagtaatagggctatacggaaacggcgtggttaccaagagcggtgactatgtgtccgccatcacacaggctgaaaggattggggagccggattacgaggtcgacgaagatatcttccgtaagaaacggctgactattatggacctccacccaggagccggcaagaccaaaagaatcctgccctctatagtgagggaggcacttaagcgccgattaagaacgctgatcctcgctcctacacgggttgtggccgcggaaatggaggaagccttgaggggcctgccaattcgctatcagactcccgcagtcaaatcggagcataccgggcgtgagatcgtggatctcatgtgccacgctacatttaccactagactgcttagctcaacccgggtacctaattacaacctgattgtgatggacgaagcccacttcacagatccgtccagtgttgctgcaaggggatacatctctacgcgcgtcgagatgggtgaagccgccgctatatttatgactgcgacacccccgggcgcaacagaccctttcccccaaagcaattccccaattgaggatatcgaacgagagatccctgagagatcatggaacaccgggtttgactggattactgactatcagggaaagacagtgtggttcgtgccctctatcaaggccggcaatgatatagctaactgcttgcggaaaagcggtaagaaagtcattcagctaagtaggaagacctttgacacggaatacccaaaaactaagctgacagattgggacttcgttgtgaccaccgatatctccgagatgggggccaactttcgcgcaggcagagtaattgacccgaggcggtgtctcaagcctgtgatcttaactgatggacccgaacgtgtcatactggccggcccaattcccgtgacccctgctagcgcggcccaacgccgagggagaatcggaaggaatccagcacaggaggacgatcagtatgttttctctggtgacccccttaaaaacgatgaagaccatgctcactggacagaggccaagatgctgctcgataatatctacacacctgagggcattatcccgactttgttcgggccagaacgggagaaaacgcaggcaattgacggagaatttcgcctgagaggcgagcaaaggaagaccttcgtggagctcatgcggcgaggtgacctgcccgtctggctttcatataaagtagcctccgctgggataagttacaaggatagagaatggtgctttacaggcgagcgcaacaatcagatcctagaagagaacatggaagtggagatttggactagggagggagaaaagaaaaagctgcggcctcgttggttggacgccagagtttatgcggatcccatggcattaaaagacttcaaggagtttgccagcggcaggaaatcgatcaccctggatatcctcacagaaattgcttctctgccaacctacctttccagccgcgccaagctggctctcgacaatatagtgatgttgcatactacggagagagggggacgagcataccagcacgccctgaacgaactacctgagtcactggagaccctcatgcttgtcgctctgttaggtgccatgacagcaggcatcttcttgtttttcatgcaggggaagggaattggcaaactgagtatgggtctcatcgcgattgccgtggcttctgggctgctttgggtcgccgaaatccaaccccagtggatagcagcttccatcattctggagtttttcctcatggtgttgctgatcccagaacctgagaagcagagaactccgcaggataatcaattaatttatgttatcctaaccatactgacaattatcggcctcattgccgcaaacgaaatgggacttatcgagaaaaccaagactgactttggcttctaccaggtgaaaacagagacgaccatactggatgtagacttgaggcccgccagcgcttggactctgtatgcggtggccacaaccatcctcaccccaatgctgcgccacacaattgaaaatacttcagcaaaccttagtctcgctgccatcgccaatcaggcagctgtcctgatggggttgggaaagggctggcctctgcatcggatggatttaggtgttcccctactggccatggggtgttacagccaggtgaacccaacgaccctcacagcgtcccttgtcatgctgttggtgcactatgctattatcggacctggcctgcaagccaaagcaactagagaggcccagaagcgtaccgctgcaggtataatgaagaatcccacagtagacggcattaccgtgatcgatctcgaaccgatctcttacgacccaaaatttgagaagcagctggggcaagttatgcttttagtgctgtgcgccggacagctcttgctgatgaggactacgtgggcgttctgtgaggtcctaacactggctaccggccctattctcactctttgggaagggaaccccggacggttctggaacaccacaatcgccgtgagcactgcaaatatatttcgcggctcctatctggccggtgctgggttggccttctcactgattaaaaacgcacagaccccacgaagaggaacaggcacgaccggtgagactctcggcgaaaagtggaaaaggcagctaaattctttagaccggaaggagtttgaagagtacaagcgcagtgggatccttgaggtcgatagaacagaagctaaatcggccctgaaggacggaagcaaaaccaagcatgcggtgtccaggggatcttcaaaaattcgatggatcgttgagcgggggatggtaaagcccaagggaaaagtggtcgatctcggctgcggtcgtgggggatggagctactatatggccactctaaagaacgtgacagaagttaaaggctacaccaagggcgggcctggacacgaggaaccgatacccatggcaacgtatggttggaatctggtgaaattgcattccggcgtcgacgtgttctacaagccaaccgagcaagtagatacactgctctgtgacatcggggagagttctagcaaccctactattgaagagggaagaacccttcgcgtgctgaagatggttgaaccctggttgtcatccaaacctgagttttgcatcaaggtcctgaatccatatatgcccacagtgattgaagaactcgagaaattacagaggaagcacggcggtaacctggtgcggtgtcctcttagtagaaatagcactcacgaaatgtactgggtctctggggcttccggaaacatcgtttcaagcgtgaataccacatcgaaaatgctgctaaaccgcttcaccactaggcatcgaaagccaacgtatgagaaagatgtagacctcggcgccggcacacggtctgtgagtaccgaaactgagaagcccgatatgaccattatcgggagaaggctgcagcgcttgcaggaggaacacaaggagacatggcattacgaccaagaaaatccgtaccgtacgtgggcatatcacggatcctacgaggctcctagcaccggttcagcctcctctatggtcaacggcgtggttaaactgctcactaagccatgggatgtgatacccatggtcacacagcttgccatgaccgacactacaccttttgggcagcagcgggtgttcaaagaaaaggtagacaccagaacaccacaacccaaaccgggaactaggatgattatgaccacgaccgcgaattggctgtgggctttactgggcaagaagaaaaaccctcgcttgtgcacacgagaggagtttatcagcaaggttcggagtaatgcagccatcggtgctgtgttccaggaggaacaagggtggacttccgccagcgaagcagtcaacgattctagattttgggagctcgtggacaaagaaagggccctgcaccaagagggaaagtgtgagtcatgcgtgtataacatgatgggcaaacgcgaaaagaagctaggcgagttcgggagagctaaaggaagtcgggcgatttggtacatgtggcttggtgccaggtttctggagttcgaggcactcggcttcctgaatgaagatcattggtttgggcgtgagaactcctggagcggagtcgagggcgaaggtttgcaccgactggggtatatactcgaggaaatcgacaagaaagatggagaccttatgtacgctgatgacaccgccggctgggatacacgcattactgaggacgatctgcagaatgaggaattaatcaccgagcagatggcaccccatcacaagattctggccaaagctatcttcaagttgacgtatcagaacaaggttgtgaaagtactcagaccaacacctcggggcgccgtgatggacataatctctaggaaggatcaacgcgggtcgggacaggtcggtacctacggcctgaatacttttacaaacatggaagtgcagctaattagacagatggaggcggaaggggttatcacccaagacgacatgcagaatcccaaaggacttaaggagcgggtggagaaatggctgagggaatgcggcgtcgatcgactcaagcgtatggcaatttcaggtgacgattgtgtggtaaaaccactggacgagagattcgggactagcttgttatttctgaacgatatgggaaaggttcgcaaggacatcccccagtgggaaccttccaaaggctggaagaattggcaggaggtgccattctgcagtcatcactttcacaaaatattcatgaaggatggccggtctctcgtcgtgccgtgtaggaaccaagacgaacttattgggagagcccgcatcagccagggagctggttggtccctgcgggagaccgcctgcctaggcaaagcatacgctcagatgtggtcactgatgtattttcataggcgagatctcagattggccagtatggctatctgttctgccgttcccacagagtggttccctacgagccggaccacttggtccattcacgcacatcaccagtggatgacaaccgaagacatgctgaaggtgtggaatagggtctggatagaggataacccaaatatgactgacaagacacccatccactcatgggaagacattccttaccttgggaaacgcgaggatctgtggtgcggaagcctcatcggcttatcttcccgtgcgacctgggccaagaacattcatacggctatcacacaagtgagaaatctgataggtaaagaagagtatgtagactacatgccagtgatgaagcgatatagtgcccccagcgagtcggaaggggtcttgtga

SEQ ID NO: 15711 - RNA, 9867 nt, synthetic construct
  misc_feature 1..9867: note = derived and/or modified CDS sequence (opt3) from DENV-4__FJ850057__SS-prME
  source 1..9867: mol_type = other RNA
agcaccatcacactgctctgccttattcccactgccatggctttccacctgtccacgagagacggcgagcctttgatgatagtggccaagcatgaaagggggcggccattactgtttaaaaccacagagggaatcaacaagtgtactctgattgccatggatctcggtgaaatgtgcgaggacaccgtcacatacaaatgtccgctgcttgttaataccgaacccgaggatatcgactgctggtgtaacctgacttctacatgggtgatgtatggaacctgcacgcagtcaggggagcgccgacgtgaaaagagaagtgtggcgttgactcctcacagcggaatgggcctcgagaccagggctgaaacatggatgtcctctgagggtgcctggaaacatgcacagcgggtggagtcgtggattctgcgcaatccagggttcgccctgctcgctggatttatggcatacatgatcggccagactggcatacagagaaccgtcttctttgtgttaatgatgctggttgccccctcatatgggatgaggtgtgtgggagtcggtaaccgggatttcgtggaaggcgtaagcgggggagcttgggttgaccttgtgttggagcacggcggttgcgtcacaaccatggcccaggggaagcctacgctggattttgaactgactaagacaaccgcgaaagaggtggcactcctgcgcacttactgtatcgaagccagtatttccaatatcacaaccgctacgcgatgcccaacccaaggagagccctatcttaaggaggaacaggaccagcagtacatttgtagaagggatgtggtcgaccggggctggggcaacgggtgcggactgttcggtaaaggcggggttgtgacatgcgccaagttttcttgtagcggaaaaatcactggcaatttggtacaaatagagaacctcgaatataccgtggtcgtgacagttcataatggtgatactcacgcagtggggaacgacacctccaatcacggcgtcacagctaccattactcctcgttcaccaagtgtggaggtaaagctgccggattacggagaattaacgctggactgcgagccccgcagcggcatcgacttcaacgagatgattctcatgaagatgaaaaagaaaacatggcttgttcataagcagtggtttctggatttgcctctaccatggaccgccggggcggacacttctgaagtgcactggaattacaaagagagaatggtcaccttcaaggtgccccatgccaaaaggcaggatgtcacagtgctgggatcccaggaaggtgcaatgcactcagctctcgccggcgctaccgaggttgacagcggggatggaaaccacatgtttgccggccatctgaagtgtaaggtgcggatggaaaaacttcgaatcaagggtatgagttatactatgtgctctgggaaattctccatcgacaaggagatggcagagacacaacacggcacgaccgtagtcaaagtgaagtacgaaggagccggcgctccttgtaaggttccaattgagatacgcgatgtgaataaagaaaaggtcgtggggagagtaatcagctcgactcccctggcggagaacacaaactctgtgaccaatattgagttggaaccgcctttcggagactcctatatcgttataggtgtcggcaactcagcactcacactgcattggtttaggaaagggagtagcattggaaagatgttcgagtccacttaccggggcgccaaacgcatggctatcttaggtgaaaccgcctgggattttgggtctgtgggcggactgttcacgagcctaggcaaggcagtgcaccaggtctttgggtcagtttataccacaatgttcggaggcgtgagttggatgatcagaattttgatcggttttctggtgctttggattgggactaattccaggaacaccagcatggccatgacatgcatagctgtaggaggcatcactttgttcctgggttttaccgtccaggccgacatgggctgtgtggtttcttggtcagggcgtgagctcaagtgcggaagtggcattttcgtggtcgataatgtgcatacgtggacagaacaatacaaatttcagcccgagagcccagcacggctggcgtccgctatccttaacgcccacaaggacggggtttgtggaatccgatctaccactagactggagaatgtgatgtggaaacagattacaaacgaattgaattatgtactctgggagggcggtcacgacctgaccgtcgtggcaggggatgtgaagggagtcttaactaaaggcaagagggccctgacccctcccgtttcggacctaaagtacagctggaaaacatggggtaaggctaaaatattcacgccagaagcccgcaactccacctttctcatcgatggccccgacacttcagagtgccctaatgaacggagagcatggaacagtctggaggtggaggattacgggttcggaatgttcacaaccaatatttggatgaagtttagggaaggctctagcgaggtatgtgaccatcgccttatgtccgctgccatcaaagatcagaaggcggtgcacgccgacatggggtattggattgaatcaagcaaaaaccaaacatggcagatcgagaaggcttctttgatagaagtcaagacttgcctgtggccaaaaacccatacgctctggtccaatggagtgctggagagtcagatgttaatcccgaaaagctacgcaggccccttctctcagcacaactatcgacaaggttacgccacacagaccgttgggccttggcacctgggaaaacttgagattgattttggcgaatgcccaggtactaccgtgacaatccaggaggactgtgatcatcggggcccctccttgcgtactaccacagcttcagggaagctcgtcacgcagtggtgctgtagaagttgcaccatgcctccactgaggttcctaggagaagacggctgttggtatgggatggagattcgccccctgaacgagaaagaagagaatatggtaaagagccaagttactgccggacagggcacatcggaaaccttttccatgggtctcctgtgccttactttgttcgtggaggaatgtctgcggagaagggtcacacgaaagcacatgatcttagtagtggttataaccctctgcgcaattatcctagggggccttacgtggatggatctgttgcgcgcgctcattatgctgggcgacactatgtctggccggatcgggggacagatacatctagccatcatggctgtgtttaaaatgagcccgggttacgtcctgggcgtgttcctcagaaagctgacctcaagggagacagcccttatggtaattgggatggcaatgaccactgtgttgagtatccctcacgacctgatggagttaattgatggaatctccctcggcctgatacttctgaaaattgtcacacagtttgacaacacccaagttggtacactagctctctctctgactttcatccgtagcaccatgccattggtgatggcctggcgcacgatcatggcagtgctgtttgtcgtgacattaattcccctctgtcggacctcctgcctgcagaagcagtcacattgggttgaaatcactgcccttattctgggggctcaagcgttgcctgtatatctcatgaccctgatgaaaggagccagcagaaggagttggcccctaaatgagggcataatggcagtgggcctggtctctcttctcgggtccgctctgttgaagaacgatgtgccactggccggacctatggttgccggtggcttactcctggctgcatacgtgatgagcgggtcgtcagccgacctttctctggaaaaggcggctaatgtccagtgggatgagatggccgacatcacaggaagttcccccattatcgaagtgaaacaggatgaggacggcagcttctctattcgagatgtagaggaaactaacatgatcaccttgctcgtcaagctggcactaataacggtgagcggtctgtacccacttgccatcccggttacaatgaccctctggtatatgtggcaagtgaaaactcaacggtccggggctctgtgggacgtcccttcacccgcagccacacagaaggcggctttgagtgagggagtgtaccgcattatgcagagaggcttatttggcaaaacccaggttggggtgggaatccacatggaaggtgtcttccacactatgtggcatgtgacaaggggcagcgtaatttgtcacgagaccgggcggctggaaccatcttgggccgatgtgcgaaatgacatgatctcctatggaggcggttggagactcggggataagtgggacaaggaggaggacgttcaagtcctggcaatagaacccggcaaaaaccctaagcatgtgcagacgaaaccaggccttttcaagactctgaccggcgagattggggccgtgacattggattttaaacccggaacctcaggtagtcctatcatcaatcgcaagggcaaagtcattgggctatacggaaacggcgtagtgacaaagagcggtgactatgtttccgctataactcaggccgaaaggatcggggagccggattacgaggtggacgaagatattttccgtaagaaacggctgaccatcatggacctccacccaggagcaggcaagacgaaacggattctgccctctatcgtcagggaggctcttaagcgccgattaagaacactgatactcgcccctactcgggtggttgcggccgaaatggaggaagcattgaggggcctgccaatccgctatcagacccccgctgtgaaatcggagcatacagggcgtgagattgtcgatctcatgtgccacgccacctttactaccagactgcttagctcaacacgggtgcctaattacaacctgatcgtaatggacgaagctcacttcacggatccgtccagtgtggcagccaggggatacatttctactcgcgttgagatgggtgaagccgctgcgatctttatgaccgcaacacccccaggcgccaccgaccctttcccccaaagcaattccccaatagaggatattgaacgagagatccctgagagatcatggaacactgggtttgactggatcacagactatcagggaaagaccgtctggttcgtgccctctattaaggctggcaatgatatcgccaactgcttgcggaaaagcggtaagaaagtgatacagctaagtaggaagacgtttgacactgaatacccaaaaacaaagctgaccgattgggacttcgtcgttaccactgatatttccgagatgggggcaaactttcgcgccggcagagtgatcgacccgaggcggtgtctcaagcctgtaattttaacagatggacccgaacgtgtgatcctggctggcccaatacccgtcacccctgcgagcgccgcacaacgccgagggagaattggaaggaatccagctcaggaggacgatcagtatgtgttctctggtgacccccttaaaaacgatgaagaccatgcccactggacagaggcaaagatgctgctcgataatatctacactcctgagggcatcattccgacgttgttcgggccagaacgggagaaaacccaggccatcgacggagaatttcgcctgagaggcgagcaaaggaagacattcgttgagctcatgcggcgaggtgacctgcccgtgtggctttcatataaagtcgcttccgccgggattagttacaaggatagagaatggtgctttactggcgagcgcaacaatcagatactagaagagaacatggaagtagagatctggaccagggagggagaaaagaaaaagctgcggcctcgttggttggacgcgagagtgtatgcagatcccatggccttaaaagacttcaaggagtttgctagcggcaggaaatcgattacactggatatcctcaccgaaatcgcctctctgccaacttacctttccagccgcgctaagctggcactcgacaatattgttatgttgcatacgaccgagagagggggacgagcctaccagcacgctctgaacgaactacctgagtcactggagacactcatgcttgtggccctgttaggtgcaatgactgcgggcatattcttgtttttcatgcaggggaagggaatcggcaaactgagtatgggtctcattgccatcgctgtcgcctctgggctgctttgggtggcagaaattcaaccccagtggatcgctgcctccataatcctggagtttttcctcatggtcttgctgattccagaacctgagaagcagagaaccccgcaggataatcaattaatctatgtgattctaacaatcctgaccataattggcctcatcgcagccaacgaaatgggacttattgagaaaactaagacagactttggcttctaccaggttaaaacggagaccactatcctggatgtggacttgaggcccgctagcgcgtggacactgtatgccgtagcaaccaccatactcacaccaatgctgcgccacactatcgaaaatacgtcagctaaccttagtctcgccgccattgcaaatcaggctgccgtgctgatggggttgggaaagggctggcctctgcatcggatggatttaggtgtccccctactggcgatggggtgttacagccaggttaacccaaccacactcactgcttcccttgtgatgctgttggtccactatgccatcattggacctggcctgcaagcaaaagccaccagagaggctcagaagcgtacagcagccggtatcatgaagaatcccaccgtggacggcataactgtaattgatctcgaaccgatctcttacgacccaaaatttgagaagcagctggggcaagtgatgcttttagttctgtgcgcgggacagctcttgctgatgaggacgacatgggctttctgtgaggtgctaaccctggccactggccctaccctcacactttgggaagggaaccccggacggttctggaacactaccatcgcagtcagcacagccaatatttttcgcggctcctatctggctggtgccgggttggcattctcactgatcaaaaacgctcagacgccacgaagaggaaccggcactacaggtgagaccctcggcgaaaagtggaaaaggcagctaaattctttagaccggaaggagtttgaagagtacaagcgcagtgggatacttgaggtggatagaactgaagccaaatcggcgctgaaggacggaagcaaaacaaagcatgccgtctccaggggatcttcaaaaattcgatggatcgtggagcgggggatggttaagcccaagggaaaagtagtggatctcggctgcggtcgtgggggatggagctactatatggcaaccctaaagaacgtcacggaagtgaaaggctacaccaagggcgggcctggacacgaggaaccgattcccatggctacatatggttggaatctggttaaattgcattccggcgtggacgtcttctacaagccaactgagcaagtggataccctgctctgtgacatcggggagagttctagcaaccctacaatagaagagggaagaactcttcgcgtactgaagatggtggaaccctggttgtcatccaaacctgagttttgcatcaaggttctgaatccatatatgcccaccgtcattgaagaactcgagaaattacagaggaagcacggcggtaacctggtgcggtgtcctcttagtagaaatagcacacacgaaatgtactgggtgtctggggcctccggaaacatcgtctcaagcgttaataccacttcgaaaatgctgctaaaccgcttcacgacaaggcatcgaaagccaacctatgagaaagatgtggacctcggcgcaggcactcggtctgtaagtaccgaaacagagaagcccgatatgacgattatcgggagaaggctgcagcgcttgcaggaggaacacaaggagacctggcattacgaccaagaaaatccgtaccgtacttgggcttatcacggatcctacgaggcccctagcacaggttcagcctcctctatggtgaacggcgtcgtgaaactgctcaccaagccatgggatgttattcccatggtgactcagcttgcgatgacagacaccacaccttttgggcagcagcgggtcttcaaagaaaaggtggacactagaaccccacaacccaaaccgggaacgaggatgatcatgaccacaactgctaattggctgtgggcattactgggcaagaagaaaaaccctcgcttgtgcacccgagaggagtttataagcaaggtacggagtaatgccgctattggtgccgttttccaggaggaacaggggtggacatccgcaagcgaagccgtgaacgattctagattttgggagctcgtcgacaaagaaagggctctgcaccaagagggaaagtgtgagtcatgcgtgtataacatgatgggcaaacgcgaaaagaagctaggcgagttcgggagagcgaaaggaagtcgggccatctggtacatgtggcttggtgcaaggtttctggagttcgaggctctcggcttcctgaatgaagatcattggtttgggcgtgagaactcctggagcggagtggagggcgaaggtttgcaccgactggggtatatcctcgaggaaattgacaagaaagatggagaccttatgtacgccgatgacactgcaggctgggatacccgcataacggaggacgatctgcagaatgaggaattaatcacagagcagatggcaccccatcacaagattctggctaaagccatcttcaagttgacctatcagaacaaggtcgttaaagtgctcagaccaactcctcggggcgcggtaatggacattatctctaggaaggatcaacgcgggtcgggacaggtgggtacatacggcctgaatacctttactaacatggaagtccagctaataagacagatggaggcagaaggggtgatcacccaagacgacatgcagaatcccaaaggacttaaggagcgggttgagaaatggctgagggaatgcggcgtggatcgactcaagcgtatggccatttcaggtgacgattgtgtcgtgaaaccactggacgagagattcgggacaagcctcttatttctgaacgatatgggaaaggtacgcaaggacatcccccagtgggaaccttccaaaggctggaagaattggcaggaggttccattctgcagtcatcactttcacaaaattttcatgaaggatggccggtctctcgtggtcccgtgtaggaaccaagacgaacttatcgggagagctcgcataagccagggagccggttggtccctgcgggagacggcatgcctaggcaaggcttacgcccagatgtggtcactgatgtattttcataggcgagatctcagattggctagtatggccatttgttctgcagtgcccaccgagtggttccctactagccggacaacctggtccatccacgcgcatcaccagtggatgactacagaagacatgctgaaggtttggaatagggtgtggatcgaggataacccaaatatgaccgacaagacgcccattcactcatgggaagacataccttaccttgggaaacgcgaggatctgtggtgcggaagcctcatcggcttatcttcccgtgccacatgggctaagaacattcataccgccatcactcaagtcagaaatctgattggtaaagaagagtatgtggactacatgccagtaatgaagcgatatagtgcacccagcgagtcggaaggggtgttgtga

SEQ ID NO: 15712 - RNA, 9867 nt, synthetic construct
  misc_feature 1..9867: note = derived and/or modified CDS sequence (opt3) from DENV-4__GQ199881__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactagaatacagaggaccgtgttctttgttttaatgatgctggtggcaccctcatatggcatgcggtgtgtcggggtgggaaaccgcgatttcgtagaaggtgttagcggcggggcctgggtggaccttgtcttggagcacggaggctgcgtgacaaccatggctcagggtaagcctacgctggattttgaactaactaagacaaccgccaaagaggtggcgctcctgcgaacttactgtatcgaagcaagtatttccaatatcacaaccgccacgagatgcccaacccaaggggagccctatcttaaggaggaacaggaccagcagtacatttgtaggcgggatgtcgttgaccgtggatggggcaacggctgcgggctgttcggaaaaggtggcgtggtaacatgcgctaagttttcttgtagcgggaaaatcactggaaatttggtgcaaatagagaacctcgaatataccgtcgtggttacagtgcataatggcgatactcacgccgtcggtaacgacacctccaatcacggggtgacagcaaccattactcctcgctcaccaagtgtagaggttaagctgccggattacggcgaattaacgctggactgcgagcccagaagcggaatcgacttcaacgagatgattctcatgaagatgaaaaagaaaacatggcttgtgcataagcagtggtttctggatttgcctctaccatggaccgctggcgccgacacttctgaagtccactggaattacaaagagaggatggtgaccttcaaggtcccccatgcgaaacggcaggatgtgacagttctggggtcccaggaaggagccatgcactcagcactcgctggtgccaccgaggtggacagcggcgatgggaaccacatgtttgctggacatctgaagtgtaaggtacgaatggaaaaacttcgcatcaagggcatgagttatactatgtgctctggtaaattctccatcgacaaggagatggccgagacacaacacgggacgaccgtcgtgaaagttaagtacgaaggcgcaggagccccttgtaaggtgccaattgagataagagatgtcaataaagaaaaggtggtaggcagggtgatcagctcgactcccctggctgagaacacaaactctgttaccaatattgagttggaaccgcctttcggggactcctatatcgtcataggagtgggtaactcagcgctcacactgcattggtttcggaaaggcagtagcattgggaagatgttcgagtccacttaccgcggagcaaaaagaatggccatcttaggcgaaaccgcttgggattttggttctgtggggggcctgttcacgagcctaggaaaggccgtccaccaggtttttggctcagtgtataccacaatgttcgggggagtgagttggatgatcaggattctcatcggctttctggtactttggattggtactaattcccgtaacaccagcatggcaatgacatgcatagccgtcgggggaatcactttgttcctgggctttaccgtgcaggctgacatgggttgtgttgtgtcttggtcaggccgggagctcaagtgcgggagtggaattttcgtcgtggataatgttcatacgtggacagaacaatacaaatttcagcccgagagcccagcccgactggcatccgcgatccttaacgctcacaaggacggcgtgtgtgggatcagatctaccactaggctggagaatgtaatgtggaaacagattacaaacgaattgaattatgtcctctgggagggaggccacgacctgaccgtggtggccggtgatgtcaagggggttttaactaaaggaaagcgcgcactgacccctcccgtgtcggacctaaagtacagctggaaaacatggggcaaggccaaaatattcacgccagaagctcggaactccacctttctcatcgatggtcccgacacttcagagtgccctaatgaaagaagggcctggaacagtctggaggtagaggattacggcttcgggatgttcacaaccaatatttggatgaagtttcgcgaaggatctagcgaggtgtgtgaccatcgacttatgtccgcagctatcaaagatcagaaggccgtccacgcggacatgggctattggattgaatcaagcaaaaaccaaacatggcagatcgagaaggcctctttgatagaagtgaagacttgcctgtggccaaaaacccatacgctctggtccaatggggttctggagagtcagatgttaatcccgaagagctacgctggacccttctctcagcacaactatcggcaaggctacgcaacacagaccgtgggtccttggcacctggggaaacttgagattgattttggagaatgcccaggcactaccgtcacaatccaggaggactgtgatcatcgtggtccctccttgagaactaccacagcctcaggcaagctcgtgacgcagtggtgctgtaggagttgcaccatgcctccactgcgcttcctaggggaagacggatgttggtatggcatggagattcggcccctgagcgagaaagaagagaacatggttaagtcgcaagtggctgccgggcagggaacttccgaaacatttttcatgggcctcctgtgccttaccttgtttgtcgaggaatgtctgagaaggcgagtaactcgcaagcacatgatcttagcagtggttataacactctgcgcgattatcctgggtgggcttacctggatggatctgttgcgggccctcattatgctgggagacacgatgtctggcagaatcggcgggcagactcatctagctataatggccgtgttcaaaatgagcccgggatacgtcctgggtgtgtttctcaggaagctgacctcacgtgagacagcacttatggtaatcggcatggctatgaccactacattgagtattcctcacgacctgatggagttaatcgatgggatttccctcggactgatccttctgaaaatagtgacccagttcgacaatacacaagtcggcactctagccctctctctgacctttattcgcagcacgatgtccttggttatggcatggcggacaatcatggccgtgctgttcgtggtcaccttaatcccactctgtagaacttcatgcctgcagaagcagagccattgggtggaaattaccgctcttatcctgggtgcgcaagccttgcccgtttatctcatgacactgatgaaaggggcaagtaggcgatcttggcctctaaacgagggaatgatggctgtaggcctggtgtcccttctcggcagcgccctgttgaagaatgatgtccccctggccgggccaatggtggctggaggtttactcctggcagcctacgttatgtcgggctcatctgcggaccttagtctggaaaaggctgccaacgtgcagtgggatgagatggcagacattactgggtccagccctataatcgaagtcaaacaggatgaggacggatcttttagcattcgggatgtggaggaaaccaatatgatcacgttgctcgtaaagctggccctaattacagtctccggcctgtacccccttgctatcccagtgaccatgactctctggtatatgtggcaggttaaaacacaacgctcaggtgcactgtgggacgtgccgagtcctgccgcgacccagaaggctgccttgagcgagggggtctacagaataatgcagaggggattattcggcaaaactcaggtgggcgttgggatccacatggaaggagtgttccacacaatgtggcatgtcacccggggttctgtgatttgtcacgagacgggccgactggaaccctcctgggcagatgtaagaaacgacatgatctcatatgggggaggctggcgcctcggtgataagtgggacaaggaggaggacgtgcaagttctggccattgaaccagggaaaaatcccaagcatgtccagactaaacctggactttttaagaccctgacaggcgagatcggcgctgtgaccttggatttcaaaccagggagtagcggatcccccataattaacaggaagggtaaagtgatcggcctatacgggaatggagtcgtaacaaagtctggcgactatgtgtcggccatcactcaggcagaacgtattggtgagcctgattacgaggttgacgaagatatatttcggaagaaaagactgaccatcatggacctccacccgggggctggaaagacgaaaaggattctgccaagcatcgtgcgcgaggcccttaagcgaagattacggacactgattctcgcgcccactagggtcgtggccgcagaaatggaggaagctttgcgcggcctgcctatccgttatcagaccccagccgttaaatcagagcatacaggcagagagatagtggatctcatgtgccacgctaccttcactacccggctgctttccagtacaagggtccccaactacaatctgatcgtgatggacgaagcacactttacggatccttctagcgtagccgcccgcgggtacatttccactcgagtggagatgggagaagctgcggcaatcttcatgaccgccacaccgcccggtgctaccgacccatttcctcaatcaaactctcccattgaggatatcgaaagagagataccagagcggagctggaatactggcttcgactggattacagactatcaggggaagaccgtttggtttgtccctagtatcaaggccggaaacgatatcgcaaattgcttgaggaaatccggcaagaaagtgattcagctaagccgcaagacgttcgacactgaataccccaaaacaaagctgaccgattgggactttgtggtcaccactgatatctctgagatgggtgccaacttcagagctgggagggttatagacccacggcgttgtctcaagccggtgattttaacagatggccctgaacgcgtaatcctggcgggacccattccagtgacccccgcctcagcagctcaacgaagaggcaggatcgggcggaaccctgcccaggaggacgatcagtatgtcttctccggagacccacttaaaaatgatgaagaccatgcacactggacagaggccaagatgctgctcgataacatatacactcccgagggtattatccctacgttgtttggcccggaacgcgagaaaacccaggctatcgacggggaattcagactgaggggagagcaacggaagacatttgtggagctcatgcgaagaggcgacctgccagtttggcttagttataaagtggccagcgcgggtatttcgtacaaggatcgcgaatggtgcttcactggggagaggaataaccagatcctagaagagaatatggaagtcgagatttggacccgggagggcgaaaagaaaaagctgcgtcccagatggttggacgcaagggtatatgccgatcctatggctttaaaagactttaaggagttcgcctctggacgcaaatccataacactggatatcctcaccgaaattgctagcctgcccacttacctttcaagtcgggcaaagctggccctcgacaacatcgtgatgttgcatacgaccgagcgaggcgggagagcttaccagcacgccctgaatgaactaccagagtctctggagacactcatgcttgttgcactgttaggagcgatgactgccggtatctttttgttctttatgcagggcaaggggattggaaaactgtccatgggcctcataaccatcgctgtggccagcggtctgctttgggtcgcagaaattcaacctcagtggatcgctgcctcaattatcctggagttctttctcatggtgttgctgatacccgaaccagagaagcagaggacacctcaggataaccaattaatctatgtcattctagcaatcctgaccattatcgggctcatagccgctaatgaaatgggccttattgagaaaactaagacagacttcggattttaccaggtgaaaacggagaccactatcctggatgttgacttgcgcccggcgagtgcctggacactgtatgcagtggctaccaccattctcacacccatgctgcggcacactatcgaaaacacgagcgccaatctttccctcgccgcaatagctaaccaggccgcggtactgatgggcttggggaagggatggccactgcatagaatggatttaggcgtgcctctactggctatgggttgttactctcaggtcaatcccaccacactcactgccagccttgttatgctgttggtgcactatgcaatcattgggccaggactgcaagccaaagctacccgtgaggcacagaagaggacagccgcgggcatcatgaagaaccctaccgtcgacggtattactgtgatcgatctcgaacccatatcctacgacccgaaattcgagaagcagctgggccaagtaatgcttttagtgctgtgcgctgggcagctcttgctgatgcggacgacatgggccttctgtgaggttctaaccctggcaactggaccaattctcaccctttgggaaggcaatcctgggcgcttttggaacacaactatcgccgtgtcaaccgctaacatcttccgaggatcttatctggccggcgcaggtttggcttttagtctgattaaaaatgcccagacacccagaagggggacgggaaccactggcgagacactcggtgaaaagtggaaacggcagctgaactcgttagaccgcaaggagttcgaagagtacaagagaagcggcatccttgaggtcgataggaccgaagcgaaatccgccctgaaggacgggtctaaaataaagcatgcagtgtcacgaggaagctccaaaattcggtggatcgtcgagcgtggcatggtgaagccaaaggggaaagttgtagatctcggatgcggcagaggtgggtggagttactatatggctactctaaagaatgtgacagaagtcaaaggatacaccaagggcggccccgggcacgaggaacctattccgatggccacgtatggatggaacctggtgaaattgcattctggtgttgacgtgttttacaagcccaccgagcaagtcgatacactgctctgtgacatcggcgagagctcatccaatccaactatagaagaggggcgcacccttagggtgctgaagatggtagaaccttggttgagtagcaaacccgagttctgcatcaaggtgctgaacccttatatgccaacagttattgaagagctcgagaaattacagcggaagcacggaggcaatctggtcagatgtcccctttctcgcaactccactcacgaaatgtactgggtgtcaggtgcaagcgggaatatcgtgtcgtctgtcaacaccacaagtaaaatgctgctaaataggtttaccactcgacatcggaagcctacgtatgagaaagatgttgacctcggagctggcacaagatccgtgagcaccgaaactgagaagccagatatgaccattatcggcaggcgcctgcagcgtttgcaggaggaacacaaggagacatggcattacgaccaagaaaacccctaccggacgtgggcctatcacgggtcatacgaggccccgtccaccggatctgcgagcagtatggtaaatggtgtggtcaaactgctcactaagccttgggatgtgattccaatggttacacagcttgctatgaccgacactacacccttcggccagcagagagtgtttaaagaaaaggtcgacaccaggacacctcaaccaaaacccgggactcgcatggtgatgaccacgaccgcaaactggctgtgggccttactgggaaagaagaaaaatccgcgattgtgcacacgggaggagttcatctccaaggtaagaagcaacgctgccataggcgcagtttttcaggaagagcagggttggacttctgcctcagaagctgtgaatgatagtaggttctgggagctcgtcgacaaagaacgcgcgctgcaccaagaggggaagtgtgagtcctgcgtgtataacatgatgggaaaaagagaaaagaagctaggcgagtttggccgggccaaagggagcagggcaatttggtacatgtggcttggagctcgtttcctggaattcgaggccctcggttttctgaacgaagatcattggttcggccgagagaattcttggtcgggggtggagggagaaggcttgcaccgcctgggttatatcctcgaggaaatcgacaagaaagatggggaccttatgtacgcagatgacaccgccggatgggatacaagaattactgaggacgatctgcagaacgaggaattaataaccgagcagatggctcctcatcacaagatcctggccaaagcgatttttaagttgacgtatcagaataaggtcgttaaagtgctccggcccacaccaaggggcgcagtaatggacatcatttcacgcaaggatcaaagaggcagcgggcaggtgggaacctacggtctgaacactttcacaaatatggaagtccagctaatccggcagatggaggccgaaggcgtgataacccaagacgacatgcagaaccctaaagggcttaaggagagggttgagaaatggctgcgagaatgcggagtggatcgtctcaagagaatggctatctccggcgacgattgtgtcgtgaaacccctggacgagcgctttggtactagtttgttattcctgaatgatatggggaaggtacggaaggacattccacagtgggaaccctctaaaggatggaagaactggcaggaggttcctttttgcagccatcacttccacaaaatctttatgaaggatggcaggtccctcgtggtcccatgtagaaatcaagacgaacttattggccgcgcccggatctcacagggggcaggatggagtctgagggagaccgcttgcctaggtaaagcctacgctcagatgtggtctctgatgtatttccatcgaagagatctccggttggccagcatggcaatatgttccgcggtgccgacagagtggtttcccacgtcaaggaccacttggagcattcacgcccatcaccagtggatgacaaccgaagacatgctgaaggtttggaaccgcgtgtggatcgaggataatcctaacatgatcgacaagactccagtccactcttgggaagacattccctaccttggcaaacgtgaggatctgtggtgcgggtccctcataggattaagtagcagagctacatgggccaagaatatccataccgcaattacgcaagtgcgaaacctgatcggcaaagaagagtatgtagactacatgcctgtgatgaagaggtattcggctccatccgagtctgaaggtgtcttgtga

SEQ ID NO: 15713 - RNA, 9867 nt, synthetic construct
  misc_feature 1..9867: note = derived and/or modified CDS sequence (opt3) from DENV-4__GQ199882__SS-prME
  source 1..9867: mol_type = other RNA
agcaccatcacactgctctgccttattcccactgtgatggccttccacctgtccacgcgggacggagagcctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctcatcggttttctggtactttggattgggactaattccagaaacaccagcatggcaatgacatgcatagccgtcggaggcatcactttgttcctgggttttaccgtgcaggctgacatgggctgtgttgtgtcttggtcagggcgtgagctcaagtgcggaagtggcattttcgtcgtggataatgttcatacgtggacagaacaatacaaatttcagcccgagagcccagcccggctggcatccgcgatccttaacgctcacaaggacggggtgtgtggaatccgatctaccactagactggagaatgtaatgtggaaacagattacaaacgaattgaattatgtcctctgggagggcggtcacgacctgaccgtggtggccggggatgtcaagggagttttaactaaaggcaagagggcactgacccctcccgtgtcggacctaaagtacagctggaaaacatggggtaaggccaaaatattcacgccagaagctcgcaactccacctttctcatcgatggccccgacacttcagagtgccctaatgaacggagagcctggaacagtctggaggtagaggattacgggttcggaatgttcacaaccaatatttggatgaagtttagggaaggctctagcgaggtgtgtgaccatcgccttatgtccgcagctatcaaagatcagaaggccgtccacgcggacatggggtattggattgaatcaagcaaaaaccaaacatggcagatcgagaaggcctctttgatagaagtgaagacttgcctgtggccaaaaacccatacgctctggtccaatggagttctggagagtcagatgttaatcccgaaaagctacgctggccccttctctcagcacaactatcgacaaggttacgcaacacagaccgtggggccttggcacctgggaaaacttgagattgattttggcgaatgcccaggtactaccgtcacaatccaggaggactgtgatcatcggggcccctccttgcgtactaccacagcctcagggaagctcgtgacgcagtggtgctgtagaagttgcaccatgcctccactgaggttcctaggagaagacggctgttggtatgggatggagattcgccccctgagcgagaaagaagagaacatggttaagtcgcaagtggctgccggacagggcacttccgaaacattttctatgggtctcctgtgccttaccttgttcgtcgaggaatgtctgcggagaagggtaactcgaaagcacatgatcttagcagtggttataacactctgcgcgattatcctagggggacttacctggatggatctgttgcgcgccctcattatgctgggcgacacgatgagcggccggatcgggggacagactcatctagctataatggccgtgtttaaaatgtcaccgggttacgtcctgggcgtgttcctcagaaagctgaccagtagggagacagcacttatggtaatcgggatggctatgaccactacattgtccattcctcacgacctgatggagttaatcgatggaatttctctcggcctgatccttctgaaaatagtgacccagtttgacaatacacaagtcggtactctagccctcagcctgaccttcattcgttccacgatgtcattggttatggcatggcgcacaatcatggccgtgctgtttgtggtcaccttaatcccactctgtcggactagctgcctgcagaagcagagtcattgggtggaaattaccgctcttatcctgggggcgcaagccttgcccgtttatctcatgacactgatgaaaggagcatctagaaggtcctggcctctaaacgagggcattatggctgtaggcctggtgagccttctcgggtcggccctgttgaagaatgatgtccccctggccggaccaatggtggctggtggcttactcctggcagcctacgttatgtcagggtctagtgcggacctttccctggaaaaggctgccaacgtgcagtgggatgagatggcagacataactggaagctctcctatcattgaagtcaaacaggatgaggacggcagcttctccatccgagatgtggaggaaaccaatatgattacgttgctcgtaaagctggccctaatcacagtctcaggtctgtacccccttgctataccagtgaccatgactctctggtatatgtggcaggttaaaacacaacggagtggggcactgtgggacgtgccgagccctgccgcgacccagaaggctgccttgtctgagggagtctaccgcatcatgcagagaggcttatttggcaaaactcaggtgggggttggcattcacatggaaggtgtgttccacacaatgtggcatgtcaccaggggctccgtgatctgtcacgagacggggcggctggaaccctcatgggcagatgtacgaaacgacatgattagttatggaggcggttggagactcggggataagtgggacaaggaggaggacgtgcaagttctggccatcgaaccaggcaaaaatcccaagcatgtccagactaaacctggccttttcaagaccctgacaggcgagataggggctgtgaccttggattttaaaccaggaacaagcggttcccccattatcaaccgcaagggcaaagtgatcgggctatacggaaatggcgtcgtaactaagtctggtgactatgtgtcggccattacccaggcagaaaggataggggagcctgattacgaggttgacgaagatatcttccgtaagaaacggctgacgattatggacctccacccgggagctggcaagacaaaaagaatcctgccaagcattgtgagggaggcccttaagcgccgattaagaactctgatcctcgcgcccacccgggtcgtggccgcagaaatggaggaggctttgaggggcctgcctatacgctatcagacaccagccgttaaatcagagcataccgggcgtgagatcgtggatctcatgtgccacgctacttttaccacaagactgctttccagtacgcgggtccccaactacaatctgattgtgatggacgaagcacacttcactgatccttctagcgtagccgccaggggatacatctccacccgcgtggagatgggtgaagctgcggcaatttttatgacagccaccccgcccggcgctactgacccattccctcaatcaaactctcccatcgaggatatagaacgagagattccagagagaagctggaatacagggtttgactggatcaccgactatcagggaaagacggtttggttcgtccctagtatcaaggccggcaacgatattgcaaattgcttgcggaaatccggtaagaaagtgatccagctaagcaggaagacttttgacacagaataccccaaaaccaagctgaccgattgggacttcgtggtcactacagatatatctgagatgggggccaactttcgcgctggcagagttattgacccaaggcggtgtctcaagccggtgatcttaaccgatggatcagaacgtgtaattctggcgggccctatccccgtgacaccagcctccgcagctcaacgccgagggagaataggaaggaaccccgcccaggaggacgatcagtatgtcttcagtggtgaccctcttaaaaatgatgaagaccatgcacactggactgaggccaagatgctgctcgataacatttacacgccagagggcatcatccccaccttgttcgggcctgaacgggagaaaacacaggctattgacggagaatttcgcctgagaggcgagcaaaggaagactttcgtggagctcatgcggcgaggtgacctgccggtttggcttagctataaagtggcctcggcggggatctcttacaaggatagagaatggtgctttaccggcgagcgcaataaccagattctagaagagaatatggaagtcgagatatggacaagggagggagaaaagaaaaagctgcggccacgttggttggacgcaagagtatatgccgatcccatggctttaaaagacttcaaggagtttgcctccggcaggaaaagcatcaccctggatattctcactgaaatcgcttcactgcctacgtaccttagttctcgcgcaaagctggccctcgacaacatcgtgatgttgcataccacagagagagggggacgagcttaccagcacgccctgaatgaactacccgagtccctggagactctcatgcttgttgcactgttaggtgcgatgaccgccggcattttcttgtttttcatgcaggggaagggaataggcaaactgagcatgggtctcatcacaattgctgtggcctcagggctgctttgggtcgcagaaatccaaccacagtggattgctgccagtatcatactggagtttttcctcatggtgttgctgatccctgaacccgagaagcagagaaccccacaggataaccaattaatttatgtcatcctaactattctgacaatcataggcctcattgcagccaatgaaatgggacttatcgagaaaacgaagaccgactttggcttctaccaggtgaaaactgagacaaccattctggatgttgacttgaggcctgctagcgcgtggaccctgtatgccgtggcaacaactatcctcacgccgatgctgcgccacaccatagaaaacacatccgctaatctttctctcgccgccatcgcaaaccaggctgccgtactgatggggttgggaaagggctggcccctgcatcggatggatttaggtgtgccactactggcgatggggtgttacagccaggtcaatcctactaccctcacagcttcccttgttatgctgttggtgcactatgccattatcggacccggcctgcaagcaaaagccaccagagaggctcagaagcgtactgcagccggtattatgaagaacccaacggtcgacggcatcacagtgatagatctcgaacctatttcatacgaccccaaatttgagaagcagctggggcaagtaatgcttttagtgctgtgcgcgggacagctcttgctgatgaggaccacttgggctttctgtgaggttctaaccctggccacaggcccgatcctcactctttgggaagggaatccaggacggttctggaacaccacaatcgcagtgtctacggccaacatttttcgcggcagttatctggctggtgccgggttggcattctcgctgatcaaaaatgctcagacccctcgaagaggaactggcacaaccggtgagactctcggcgaaaagtggaaaaggcagctgaacagcttagaccggaaggagtttgaagagtacaagcgctccgggatacttgaggtcgatagaacagaagccaaatctgcgctgaaggacggatcaaaaattaagcatgccgtgagcaggggctccagtaaaatccgatggattgtcgagcgggggatggtgaagcccaagggaaaagttgtagatctcggctgcggtcgtgggggatggtcttactatatggcaaccctaaagaatgtgacggaagtcaaaggctacaccaagggcgggccaggacacgaggaacccatccctatggctacatatggttggaacctggtgaaattgcatagcggcgttgacgtgttctacaagccgactgagcaagtcgataccctgctctgtgacataggggagtcatccagtaatcccacaatcgaagagggaagaactcttcgcgtgctgaagatggtagaaccatggttgagctctaaacctgagttttgcattaaggtgctgaacccctatatgcctaccgttatcgaggaactcgagaaattacagaggaagcacggcggtaatctggtccggtgtccactttccagaaactcaacacacgaaatgtactgggtgagcggggcctcgggaaatattgtgtctagtgtcaacaccacttccaaaatgctgctaaatcgcttcacgacaaggcatcgaaagcccacctatgagaaagatgttgacctcggcgcaggcactcggagcgtgtcaaccgaaacagagaagcctgatatgacgatcattgggagaaggctgcagcgcttgcaggaggaacacaaggagacctggcattacgaccaagaaaacccataccgtacttgggcttatcacggatcctacgaggccccctctacaggtagcgccagttccatggtaaatggcgtggtcaaactgctcaccaagccgtgggatgtgatccctatggttactcagcttgcgatgacagacaccacaccatttgggcagcagcgggtgttcaaagaaaaggtcgacactagaacgccccaacctaaaccaggaaccaggatggtgatgaccacaactgctaactggctgtgggcattactgggcaagaagaaaaatccccgcttgtgcacccgagaggagtttataagcaaggtacggtctaacgccgctattggtgccgttttccaggaagaacaggggtggacatcagcaagtgaagccgtgaatgattccagattttgggagctcgtcgacaaagaaagggctctgcaccaagagggaaagtgtgagagctgcgtgtataacatgatgggcaaacgcgaaaagaagctaggcgagttcgggagagcgaaaggatctcgggccatctggtacatgtggcttggtgcaaggtttctggagttcgaggctctcggcttcctgaacgaagatcattggtttgggcgtgaaaattcgtggtcaggagtggagggcgaaggtttgcaccgactggggtatatcctcgaggaaattgacaagaaagatggagaccttatgtacgccgatgacactgcaggctgggatacccgcataacggaggacgatctgcagaacgaggaattaatcacagagcagatggccccgcatcacaagattctggctaaagccatcttcaagttgacctatcagaataaggtcgttaaagtgctcagacctactccccggggcgcggtaatggacattatcagcaggaaggatcaacgcgggtccggacaggtgggtacatacggcctgaacacctttactaatatggaagtccagctaataagacagatggaggcagaaggggtgatcacccaagacgacatgcagaacccaaaaggacttaaggagcgggttgagaaatggctgagggaatgcggcgtggatcgactcaagcgtatggccattagtggtgacgattgtgtcgtgaaacctctggacgagagattcgggacatctttgttatttctgaatgatatgggaaaggtacgcaaggacatcccccagtgggaaccaagcaaaggctggaagaactggcaggaggttcccttctgctcccatcactttcacaaaattttcatgaaggatggccggtcactcgtggtcccttgtaggaatcaagacgaacttatcgggagagctcgcataagtcagggagccggttggtctctgcgggagacggcatgcctaggcaaggcttacgcccagatgtggagcctgatgtattttcataggcgagatctcagattggcttccatggccatttgttcagcagtgccaaccgagtggttcccgactagccggacaacctggtctatccacgcgcatcaccagtggatgactacagaagacatgctgaaggtttggaacagggtgtggatcgaggataatcccaacatgattgacaagacccctgtccactcctgggaagacataccataccttgggaaacgcgaggatctgtggtgcggaagtctcatcggcttaagctcgcgtgccacgtgggctaagaatattcatacagccatcacccaagtgagaaacctgattggtaaagaagagtatgtagactacatgcccgtgatgaagcgatattccgcaccttctgagtcagaaggggtcttgtga

SEQ ID NO: 15714 - RNA, 9867 nt, synthetic construct
  misc_feature 1..9867: note = derived and/or modified CDS sequence (opt3) from DENV-4__GQ199883__SS-prME
  source 1..9867: mol_type = other RNA
agcaccatcacactgctctgccttattcccactgtgatggcattccacctgtccacgcgggacggcgagcctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccagcgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgctgaggtaaagctgccggattacggagaattaacgctggactgcgagccccgcagcggcatcgacttcaacgagatgattctcatgaagatgaaaaagaaaacatggcttgttcataagcagtggtttctggatttgcctctaccatggaccgccggggcggacacttctgaagtgcactggaattacaaagagagaatggtcaccttcaaggtgccccatgccaaaaggcaggatgtcacagtgctgggatcccaggaaggtgcaatgcactcagctctcgccggcgctaccgaggttgacagcggggatggaaaccacatgtttgccggccatctgaagtgtaaggtgcggatggaaaaacttcgaatcaagggtatgagttatactatgtgctctgggaaattctccatcgacaaggagatggcagagacacaacacggcacgaccgtagtcaaagtgaagtacgaaggagccggcgctccttgtaaggttccaattgagatacgcgatgtgaataaagaaaaggtcgtggggagagtaatcagctcgactcccctggcggagaacacaaactctgtgaccaatattgagttggaaccgcctttcggagactcctatatcgttataggtgtcggcaactcagcactcacactgcattggtttaggaaagggagtagcattggaaagatgttcgagtccacttaccggggcgccaaacgcatggctatcttaggtgaaaccgcctgggattttgggtctgtgggcggactgttcacgagcctaggcaaggcagtgcaccaggtctttgggtcagtttataccacaatgttcggaggcgtgagttggatgatcaggattctcatcggttttctggtgctttggattgggactaattccagaaacaccagcatggccatgacatgcatagctgtaggaggcatcactttgttcctgggttttaccgtccaggccgacatgggctgtgtggtttcttggtcagggcgtgagctcaagtgcggaagtggcattttcgtggtcgataatgtgcatacgtggacagaacaatacaaatttcagcccgagagcccagcacggctggcgtccgctatccttaacgcccacaaggacggggtttgtggaatccgatctaccactagactggagaatgtgatgtggaaacagattacaaacgaattgaattatgtactctgggagggcggtcacgacctgaccgtcgtggcaggggatgtgaagggagtcttaactaaaggcaagagggccctgacccctcccgtttcggacctaaagtacagctggaaaacatggggtaaggctaaaatattcacgccagaagcccgcaactccacctttctcatcgatggccccgacacttcagagtgccctaatgaacggagagcatggaacagtctggaggtggaggattacgggttcggaatgttcacaaccaatatttggatgaagtttagggaaggctctagcgaggtatgtgaccatcgccttatgtccgctgccatcaaagatcagaaggcggtgcacgccgacatggggtattggattgaatcaagcaaaaaccaaacatggcagatcgagaaggcttctttgatagaagtcaagacttgcctgtggccaaaaacccatacgctctggtccaatggagtgctggagagtcagatgttaatcccgaaaagctacgcaggccccttctctcagcacaactatcgacaaggttacgccacacagaccgttgggccttggcacctgggaaaacttgagattgattttggcgaatgcccaggtactaccgtgacaatccaggaggactgtgatcatcggggcccctccttgcgtactaccacagcttcagggaagctcgtcacgcagtggtgctgtagaagttgcaccatgcctccactgaggttcctaggagaagacggctgttggtatgggatggagattcgccccctgagcgagaaagaagagaacatggtgaagtcgcaagttgccgcaggacagggcacttccgaaacattttctatgggtctcctgtgccttaccttgttcgtggaggaatgtctgcggagaagggtcactcgaaagcacatgatcttagcggtagtgataacactctgcgccattatcctagggggacttacctggatggatctgttgcgcgctctcattatgctgggcgacacgatgagcggccggatcgggggacagactcatctagccataatggcagtttttaaaatgtcaccgggttacgtgctgggcgtcttcctcagaaagctgaccagtagggagacagctcttatggtgatcgggatggccatgaccactacattgtccattcctcacgacctgatggagttaatcgatggaatttctctcggcctgatccttctgaaaatagtaacccagtttgacaatacacaagtgggtactctagcactcagcctgaccttcattcgttccacgatgtcattggtcatggcctggcgcacaatcatggctgttctgtttgtggtgaccttaatcccactctgtcggactagctgcctgcagaagcagagtcattgggtcgaaattaccgcgcttatcctgggggcccaagcattgcccgtgtatctcatgacactgatgaaaggagcttctagaaggtcctggcctctaaacgagggcattatggccgttggcctggtaagccttctcgggtcggccctgttgaagaatgatgtgcccctggctggaccaatggtcgccggtggattactcctggcagcgtacgtgatgtcagggtctagtgctgacctttccctggaaaaggccgcaaacgttcagtgggatgagatggccgacataactggaagctctcctatcattgaagtgaaacaggatgaggacggcagcttctccatccgagatgtcgaggaaaccaatatgattacgttgctcgtgaagctggctctaatcacagtatcaggtctgtacccccttgcaataccagtcaccatgactctctggtatatgtggcaagtgaaaacacaacggagtggggccctgtgggacgttccgagccctgcggctacccagaaggccgcattgtctgagggagtgtaccgcatcatgcagagaggcttatttggcaaaactcaggtcggggtgggcattcacatggaaggtgttttccacacaatgtggcatgtgaccaggggctccgtcatctgtcacgagacggggcggctggaaccctcatgggccgatgtgcgaaacgacatgattagttatggaggcggttggagactcggggataagtgggacaaggaggaggacgtacaagtgctggctatcgaaccaggcaaaaatcccaagcatgttcagactaaacctggccttttcaagaccctgacaggcgagataggggccgtcaccttggattttaaaccaggaacaagcggttcccccattatcaaccgcaagggcaaagtgatcgggctatacggaaatggcgtggtcactaagtctggtgactatgtatcggcaattacccaggctgaaaggataggggagcctgattacgaggtggacgaagatatcttccgtaagaaacggctgacgattatggacctccacccgggagccggcaagacaaaaagaatcctgccaagcattgttagggaggcgcttaagcgccgattaagaactctgatcctcgcccccacccgggtggtcgcagctgaaatggaggaagccttgaggggcctgcctatacgctatcagacaccagctgtgaaatcagagcataccgggcgtgagatcgttgatctcatgtgccacgcaacttttaccacaagactgctttccagtacgcgggtgcccaactacaatctgattgtcatggacgaagcccacttcactgatccttctagcgtggccgctaggggatacatctccacccgcgtagagatgggtgaagcggcagccatttttatgacagctaccccgcccggcgccactgacccattccctcaatcaaactctcccatcgaggatatagaacgagagattccagagagaagctggaatacagggtttgactggatcaccgactatcagggaaagacggtgtggttcgttcctagtatcaaggcaggcaacgatattgccaattgcttgcggaaatccggtaagaaagtcatccagctaagcaggaagacttttgacacagaataccccaaaaccaagctgaccgattgggacttcgtggtgactacagatatatctgagatgggggctaactttcgcgcgggcagagtcattgacccaaggcggtgtctcaagccggttatcttaaccgatggacctgaacgtgtgattctggccggccccatcccagtaacacccgcatcagctgcccaacgccgagggagaataggaaggaaccctgcacaggaggacgatcagtatgtgttctccggtgacccacttaaaaatgatgaagaccatgcccactggactgaggctaagatgctgctcgataacatttacacgcccgagggcatcatccctaccttgttcgggccggaacgggagaaaacacaggccattgacggagaatttcgcctgagaggcgagcaaaggaagactttcgtcgagctcatgcggcgaggtgacctgccagtgtggcttagttataaagttgcgagcgcagggatctcgtacaaggatagagaatggtgctttaccggcgagcgcaataaccagattctagaagagaatatggaagtggagatatggacaagggagggagaaaagaaaaagctgcggccccgttggttggacgccagagtctatgctgatcctatggccttaaaagacttcaaggagtttgcttctggcaggaaatccatcaccctggatattctcactgaaatcgcaagcctgcccacgtacctttcaagtcgcgccaagctggctctcgacaacatcgtaatgttgcataccacagagagagggggacgagcctaccagcacgcactgaatgaactaccagagtctctggagactctcatgcttgtggcgctgttaggtgccatgaccgctggcattttcttgtttttcatgcaggggaagggaataggcaaactgtccatgggtctcatcacaattgccgttgcaagcgggctgctttgggtggctgaaatccaacctcagtggattgccgcatcaatcatactggagtttttcctcatggtcttgctgatccccgaaccagagaagcagagaacccctcaggataaccaattaatttatgtgatcctagccattctgactatcataggcctcattgctgcgaatgaaatgggacttatcgagaaaacaaagacggactttggcttctaccaggtcaaaaccgagactacaattctggatgtggacttgaggccggccagtgcatggaccctgtatgctgttgccaccacaatcctcactcccatgctgcgccacacgatagaaaacaccagcgccaatctttccctcgcagctatcgccaaccaggcggctgtgctgatggggttgggaaagggctggccactgcatcggatggatttaggtgtacctctactggccatggggtgttactctcaggtgaatcccacaactctcaccgcaagccttgtcatgctgttggttcactatgccattatcggaccaggcctgcaagctaaagcaacaagagaggcccagaagcgtaccgcggctggtattatgaagaaccctactgtggacggcatcacggtcatagatctcgaacccatttcctacgacccgaaatttgagaagcagctggggcaagtgatgcttttagtactgtgcgccggacagctcttgctgatgaggacaacctgggcattctgtgaggtgctaactctggccaccggcccaatcctcacactttgggaagggaatcctggacggttctggaacactaccatcgctgtttcaacagccaacatttttcgcggctcttatctggccggtgctgggttggccttcagtctgatcaaaaatgcgcagacgccccgaagaggaaccggcactacaggtgagaccctcggcgaaaagtggaaaaggcagctgaactcgttagaccggaaggagtttgaagagtacaagcgcagcgggatacttgaggtggatagaactgaagccaaatccgcactgaaggacggatctaaaattaagcatgctgtctcaaggggcagctccaaaatccgatggattgtggagcgggggatggtcaagccaaagggaaaagtggttgatctcggctgcggtcgtgggggatggagttactatatggccacactaaagaatgtaaccgaagtgaaaggctacacgaagggcgggcccggacacgaggaacctatcccgatggcaacctatggttggaacctggtcaaattgcattctggcgtggacgttttctacaagcccacagagcaagtggatactctgctctgtgacataggggagagctcatccaatccaaccatcgaagagggaagaacacttcgcgtcctgaagatggtggaaccttggttgagtagcaaacccgagttttgcattaaggtactgaacccttatatgccaactgtgatcgaggaactcgagaaattacagaggaagcacggcggtaatctggttcggtgtcccctttctagaaactccacccacgaaatgtactgggtctcaggggctagcggaaatattgtgtcgtctgtgaacacaaccagtaaaatgctgctaaatcgcttcactacgaggcatcgaaagcctacatatgagaaagatgtcgacctcggcgccggcacccggtccgttagcactgaaaccgagaagccagatatgacaatcattgggagaaggctgcagcgcttgcaggaggaacacaaggagacgtggcattacgaccaagaaaacccctaccgtacctgggcctatcacggatcatacgaggcgccgtccactggttctgctagcagtatggtgaatggcgtagtgaaactgctcacaaagccttgggatgtcatcccaatggtgacccagcttgcaatgactgacacaaccccctttgggcagcagcgggttttcaaagaaaaggtggacacaagaactcctcaaccaaaacccggaaccaggatggtcatgacgaccacagccaactggctgtgggctttactgggcaagaagaaaaatccgcgcttgtgcactcgagaggagtttatatccaaggtgcggagcaacgccgcaattggtgccgtattccaggaggaacaggggtggacctctgcttcagaagcggttaatgatagtagattttgggagctcgtggacaaagaaagggccctgcaccaagagggaaagtgtgagtcctgcgtctataacatgatgggcaaacgcgaaaagaagctaggcgagttcgggagagcaaaaggaagccgggctatctggtacatgtggcttggtgccaggtttctggagttcgaggcactcggcttcctgaacgaagatcattggtttgggcgtgaaaattcttggtcgggagtggagggcgaaggtttgcaccgactggggtatatcctcgaggaaattgacaagaaagatggagaccttatgtacgccgatgacacagctggctgggatactcgcataaccgaggacgatctgcagaacgaggaattaatcacggagcagatggcccctcatcacaagattctggcgaaagcaatcttcaagttgacatatcagaataaggtggtcaaagttctcagacccaccccacggggcgccgtgatggacattatctcaaggaaggatcaacgcgggagcggacaggtaggtacttacggcctgaacacatttaccaatatggaagtgcagctaataagacagatggaggctgaaggggtcatcactcaagacgacatgcagaaccctaaaggacttaaggagcgggtggagaaatggctgagggaatgcggcgttgatcgactcaagcgtatggccatttccggtgacgattgtgtggtcaaacccctggacgagagattcgggaccagtttgttatttctgaatgatatgggaaaggtgcgcaaggacatcccacagtgggaaccctctaaaggctggaagaactggcaggaggtacctttctgcagccatcactttcacaaaattttcatgaaggatggccggtccctcgttgtgccatgtaggaatcaagacgaacttatcgggagagcacgcatatcacagggagctggttggagtctgcgggagacagcctgcctaggcaaggcttacgcccagatgtggtctctgatgtattttcataggcgagatctcagattggcaagcatggcgatttgttccgccgtcccgacggagtggttccccacctcacggactacatggagcatccacgctcatcaccagtggatgaccactgaagacatgctgaaggtgtggaacagggtttggatcgaggataatcctaacatgattgacaagacaccagtgcactcttgggaagacataccctaccttgggaaacgcgaggatctgtggtgcggatccctcatcggcttaagtagccgtgccacctgggcaaagaatattcatacggctatcacacaagtcagaaacctgattggtaaagaagagtatgtggactacatgcctgtaatgaagcgatattcggccccatccgagtctgaaggggtgttgtga

SEQ ID NO: 15715 - RNA, 9867 nt, synthetic construct
  misc_feature 1..9867: note = derived and/or modified CDS sequence (opt3) from DENV-4__GQ199884__SS-prME
  source 1..9867: mol_type = other RNA
agcaccatcacactgctctgccttattcccactgtgatggccttccacctgtccacgcgggacggagagcctttgatgatagtcgctaagcatgaaagggggcggccgttactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctcatcggttttctggtactttggattgggactaattccagaaacaccagcatggcaatgacatgcatagccgtcggaggcatcactttgttcctgggttttaccgtgcaggctgacatgggctgtgttgtgtcttggtcagggcgtgagctcaagtgcggaagtggcattttcgtcgtggataatgttcatacgtggacagaacaatacaaatttcagcccgagagcccagcccggctggcatccgcgatccttaacgctcacaaggacggggtgtgtggaatccgatctaccactagactggagaatgtaatgtggaaacagattacaaacgaattgaattatgtcctctgggagggcggtcacgacctgaccgtggtggccggggatgtcaagggagttttaactaaaggcaagagggcactgacccctcccgtgtcggacctaaagtacagctggaaaacatggggtaaggccaaaatattcacgccagaagctcgcaactccacctttctcatcgatggccccgacacttcagagtgccctaatgaacggagagcctggaacagtctggaggtagaggattacgggttcggaatgttcacaaccaatatttggatgaagtttagggaaggctctagcgaggtgtgtgaccatcgccttatgtccgcagctatcaaagatcagaaggccgtccacgcggacatggggtattggattgaatcaagcaaaaaccaaacatggcagatcgagaaggcctctttgatagaagtgaagacttgcctgtggccaaaaacccatacgctctggtccaatggagttctggagagtcagatgttaatcccaaagagctacgctggccccttctctcagcacaactatcgacaaggttacgcaacacagaccgtggggccttggcacctgggaaaacttgagattgattttggcgaatgcccaggtactaccgtcacaatccaggaggactgtgatcatcggggcccctccttgcgtactaccacagcctcagggaagctcgtgacgcagtggtgctgtagaagttgcaccatgcctccactgaggttcctaggagaagacggctgttggtatgggatggagattcgccccctgagcgagaaagaagagaacatggttaagtcgcaagtggctgccggacagggcacttccgaaacattttctatgggtctcctgtgccttaccttgttcgtcgaggaatgtctgcggagaagggtaactcgaaagcacatgatcttagcagtggttataacactctgcgcgattatcctagggggacttacctggatggatctgttgcgcgccctcattatgctgggcgacacgatgagcggccggatcgggggacagactcatctagctataatggccgtgtttaaaatgtcaccgggttacgtcctgggcgtgttcctcagaaagctgaccagtagggagacagcacttatggtaatcgggatggctatgaccactacattgtccattcctcacgacctgatggagttaatcgatggaatttctctcggcctgatccttctgaaaatagtgacccagtttgacaatacacaagtcggtactctagccctcagcctgaccttcattcgttccacgatgtcattggttatggcatggcgcacaatcatggccgtgctgtttgtggtcaccttaatcccactctgtcggactagctgcctgcagaagcagagtcattgggtggaaattaccgctcttatcctgggggcgcaagccttgcccgtttatctcatgacactgatgaaaggagcatctagaaggtcctggcctctaaacgagggcattatggctgtaggcctggtgagccttctcgggtcggccctgttgaagaatgatgtccccctggccggaccaatggtggctggtggcttactcctggcagcctacgttatgtcagggtctagtgcggacctttccctggaaaaggctgccaacgtgcagtgggatgagatggcagacataactggaagctctcctatcattgaagtcaaacaggatgaggacggcagcttctccatccgagatgtggaggaaaccaatatgattacgttgctcgtaaagctggccctaatcacagtctcaggtctgtacccccttgctataccagtgaccatgactctctggtatatgtggcaggttaaaacacaacggagtggggcactgtgggacgtgccgagccctgccgcgacccagaaggctgccttgtctgagggagtctaccgcatcatgcagagaggcttatttggcaaaactcaggtgggggttggcattcacatggaaggtgtgttccacacaatgtggcatgtcaccaggggctccgtgatctgtcacgagacggggcggctggaaccctcatgggcagatgtacgaaacgacatgattagttatggaggcggttggagactcggggataagtgggacaaggaggaggacgtgcaagttctggccatcgaaccaggcaaaaatcccaagcatgtccagactaaacctggccttttcaagaccctgacaggcgagataggggctgtgaccttggattttaaaccaggaacaagcggttcccccattatcaaccgcaagggcaaagtgatcgggctatacggaaatggcgtcgtaactaagtctggtgactatgtgtcggccattacccaggcagaaaggataggggagcctgattacgaggttgacgaagatatcttccgtaagaaacggctgacgattatggacctccacccgggagctggcaagacaaaaagaatcctgccaagcattgtgagggaggcccttaagcgccgattaagaactctgatcctcgcgcccacccgggtcgtggccgcagaaatggaggaggctttgaggggcctgcctatacgctatcagacaccagccgttaaatcagagcataccgggcgtgagatcgtggatctcatgtgccacgctacttttaccacaagactgctttccagtacgcgggtccccaactacaatctgattgtgatggacgaagcacacttcactgatccttctagcgtagccgccaggggatacatctccacccgcgtggagatgggtgaagctgcggcaatttttatgacagccaccccgcccggcgctactgacccattccctcaatcaaactctcccatcgaggatatagaacgagagattccagagagaagctggaatacagggtttgactggatcaccgactatcagggaaagacggtttggttcgtccctagtatcaaggccggcaacgatattgcaaattgcttgcggaaatccggtaagaaagtgatccagctaagcaggaagacttttgacacagaataccccaaaaccaagctgaccgattgggacttcgtggtcactacagatatatctgagatgggggccaactttcgcgctggcagagttattgacccaaggcggtgtctcaagccggtgatcttaaccgatggacctgaacgtgtaattctggcgggccccatcccagtgacacccgcctcagcagctcaacgccgagggagaataggaaggaaccctgcccaggaggacgatcagtatgtcttctccggtgacccacttaaaaatgatgaagaccatgcacactggactgaggccaagatgctgctcgataacatttacacgcccgagggcatcatccctaccttgttcgggccggaacgggagaaaacacaggctattgacggagaatttcgcctgagaggcgagcaaaggaagactttcgtggagctcatgcggcgaggtgacctgccagtttggcttagttataaagtggccagcgcggggatctcgtacaaggatagagaatggtgctttaccggcgagcgcaataaccagattctagaagagaatatggaagtcgagatatggacaagggagggagaaaagaaaaagctgcggccccgttggttggacgcaagagtatatgccgatcctatggctttaaaagacttcaaggagtttgcctctggcaggaaatccatcaccctggatattctcactgaaatcgctagcctgcccacgtacctttcaagtcgcgcaaagctggccctcgacaacatcgtgatgttgcataccacagagagagggggacgagcttaccagcacgccctgaatgaactaccagagtctctggagactctcatgcttgttgcactgttaggtgcgatgaccgccggcattttcttgtttttcatgcaggggaagggaataggcaaactgtccatgggtctcatcacaattgctgtggccagcgggctgctttgggtcgcagaaatccaacctcagtggattgctgcctcaatcatactggagtttttcctcatggtgttgctgatccccgaaccagagaagcagagaacccctcaggataaccaattaatttatgtcatcctagcaattctgactatcataggcctcattgccgctaatgaaatgggacttatcgagaaaacaaagacggactttggcttctaccaggtgaaaaccgagactacaattctggatgttgacttgaggccggcgagtgcctggaccctgtatgcagtggctaccacaatcctcactcccatgctgcgccacacgatagaaaacaccagcgccaatctttccctcgccgcaatcgctaaccaggccgcggtactgatggggttgggaaagggctggccactgcatcggatggatttaggtgtgcctctactggctatggggtgttactctcaggtcaatcccacaactctcaccgccagccttgttatgctgttggtgcactatgcaattatcggaccaggcctgcaagccaaagctacaagagaggcacagaagcgtaccgccgcgggtattatgaagaaccctactgtcgacggcatcacggtgatagatctcgaacccatttcctacgacccgaaatttgagaagcagctggggcaagtaatgcttttagtgctgtgcgctggacagctcttgctgatgaggacaacctgggccttctgtgaggttctaactctggcaaccggcccaatcctcacactttgggaagggaatcctggacggttctggaacactaccatcgccgtgtcaacagctaacatttttcgcggctcttatctggccggtgcagggttggctttcagtctgatcaaaaatgcccagacgccccgaagaggaaccggcactacaggtgagaccctcggcgaaaagtggaaaaggcagctgaactcgttagaccggaaggagtttgaagagtacaagcgcagcgggatacttgaggtcgatagaactgaagcgaaatccgccctgaaggacggatctaaaattaagcatgcagtgtcaaggggcagctccaaaatccgatggattgtcgagcgggggatggtgaagccaaagggaaaagttgtagatctcggctgcggtcgtgggggatggagttactatatggctacactaaagaatgtgaccgaagtcaaaggctacacgaagggcgggcccggacacgaggaacctatcccgatggccacctatggttggaacctggtgaaattgcattctggcgttgacgtgttctacaagcccacagagcaagtcgatactctgctctgtgacataggggagagctcatccaatccaaccatcgaagagggaagaacacttcgcgtgctgaagatggtagaaccttggttgagtagcaaacccgagttttgcattaaggtgctgaacccttatatgccaactgttatcgaggaactcgagaaattacagaggaagcacggcggtaatctggtccggtgtcccctttctagaaactccacccacgaaatgtactgggtgtcaggggcaagcggaaatattgtgtcgtctgtcaacacaaccagtaaaatgctgctaaatcgcttcactacgaggcatcgaaagcctacatatgagaaagatgttgacctcggcgctggcacccggtccgtgagcactgaaaccgagaagccagatatgacaatcattgggagaaggctgcagcgcttgcaggaggaacacaaggagacgtggcattacgaccaagaaaacccctaccgtacctgggcctatcacggatcatacgaggccccgtccactggttctgcgagcagtatggtaaatggcgtggtcaaactgctcacaaagccttgggatgtgatcccaatggttacccagcttgctatgactgacacaaccccctttgggcagcagcgggtgttcaaagaaaaggtcgacacaagaactcctcaaccaaaacccggaaccaggatggtgatgacgaccacagcaaactggctgtgggccttactgggcaagaagaaaaatccgcgcttgtgcactcgagaggagtttatatccaaggtacggagcaacgctgccattggtgcagttttccaggaagaacaggggtggacctctgcctcagaagctgtgaatgatagtagattttgggagctcgtcgacaaagaaagggcgctgcaccaagagggaaagtgtgagtcctgcgtgtataacatgatgggcaaacgcgaaaagaagctaggcgagttcgggagagccaaaggaagccgggcaatctggtacatgtggcttggtgctaggtttctggagttcgaggccctcggcttcctgaacgaagatcattggtttgggcgtgaaaattcttggtcgggagtggagggcgaaggtttgcaccgactggggtatatcctcgaggaaattgacaagaaagatggagaccttatgtacgcagatgacacagccggctgggatactcgcataaccgaggacgatctgcagaacgaggaattaatcacggagcagatggctcctcatcacaagattctggccaaagcgatcttcaagttgacatatcagaataaggtcgttaaagtgctcagacccaccccacggggcgcagtaatggacattatctcaaggaaggatcaacgcgggagcggacaggtgggtacttacggcctgaacacatttaccaatatggaagtccagctaataagacagatggaggccgaaggggtgatcactcaagacgacatgcagaaccctaaaggacttaaggagcgggttgagaaatggctgagggaatgcggcgtggatcgactcaagcgtatggctatttccggtgacgattgtgtcgtgaaacccctggacgagagattcgggaccagtttgttatttctgaatgatatgggaaaggtacgcaaggacatcccacagtgggaaccctctaaaggctggaagaactggcaggaggttcctttctgcagccatcactttcacaaaattttcatgaaggatggccggtccctcgtggtcccatgtaggaatcaagacgaacttatcgggagagcccgcatatcacagggagcaggttggagtctgcgggagacagcttgcctaggcaaagcctacgctcagatgtggtctctgatgtattttcataggcgagatctcagattggccagcatggcaatttgttccgcggtgccgacggagtggttccccacctcacggactacatggagcatccacgcccatcaccagtggatgaccactgaagacatgctgaaggtttggaacagggtgtggatcgaggataatcctaacatgattgacaagacaccagtccactcttgggaagacataccctaccttgggaaacgcgaggatctgtggtgcggatccctcatcggcttaagtagccgtgctacctgggccaagaatattcatacggcaatcacacaagtgagaaacctgattggtaaagaagagtatgtagactacatgcctgtgatgaagcgatattcggctccatccgagtctgaaggggtcttgtga

SEQ ID NO: 15716 - RNA, 9867 nt, synthetic construct
  misc_feature 1..9867: note = derived and/or modified CDS sequence (opt3) from DENV-4__FJ882595__SS-prME
  source 1..9867: mol_type = other RNA
agcaccatcacactgctctgccttattcccactgccatggctttccacctgtccacgcgggacggcgagcctttgatgatagtggcaaagcatgaaagggggcggccgttactgtttaaaaccacagagggaatcaacaagtgtactctgattgccatggatctcggtgaaatgtgcgaggacaccgtcacatacaaatgtccgctgcttgttaataccgaacccgaggatatcgactgctggtgtaacctgacttctacatgggtgatgtatggaacctgcacgcagtcaggggagcgccgacgtgaaaagagaagtgtagcgttgactcctcacagcggaatgggcctcgagaccagggctgaaacatggatgtcctctgagggtgcctggaaacatgcacagcgggtggagtcgtggattctgcgcaatccagggttcgccctgctcgctggatttatggcatacatgatcggccagactggcatacagagaaccgtcttctttgtgttaatgatgctggttgccccctcatatgggatgaggtgtgtgggagtcggtaaccgggatttcgtggaaggcgtaagcgggggagcttgggttgaccttgtgttggagcacggcggttgcgtcacaaccatggcccaggggaagcctacgctggattttgaactaactaagacaaccgcgaaagaggtggcactcctgcgcacttactgtatcgaagccagtatttccaatatcacaaccgctacgcgatgcccaacccaaggagagccctatcttaaggaggaacaggaccagcagtacatttgtagaagggatgtggtcgaccggggctggggcaacgggtgcggactgttcggtaaaggcggggttgtgacatgcgccaagttttcttgtagcggaaaaatcactggcaatttggtacaaatagagaacctcgaatataccgtggtcgtgacagttcataatggtgatactcacgcagtggggaacgacacctccaatcacggcgtcacagctaccattactcctcgttcaccaagtgtggaggtaaagctgccggattacggagaattaacgctggactgcgagccccgcagcggcatcgacttcaacgagatgattctcatgaagatgaaaaagaaaacatggcttgttcataagcagtggtttctggatttgcctctaccatggaccgccggggcggacacttctgaagtgcactggaattacaaagagagaatggtcaccttcaaggtgccccatgccaaaaggcaggatgtcacagtgctgggatcccaggaaggtgcaatgcactcagctctcgccggcgctaccgaggttgacagcggggatggaaaccacatgtttgccggccatctgaagtgtaaggtgcggatggaaaaacttcgaatcaagggtatgagttatactatgtgctctgggaaattctccatcgacaaggagatggcagagacacaacacggcacgaccgtagtcaaagtgaagtacgaaggagccggcgctccttgtaaggttccaattgagatacgcgatgtgaataaagaaaaggtcgtggggagagtaatcagctcgactcccctggcggagaacacaaactctgtgaccaatattgagttggaaccgcctttcggagactcctatatcgttataggtgtcggcaactcagcactcacactgcattggtttaggaaagggagtagcattggaaagatgttcgagtccacttaccggggcgccaaacgcatggctatcttaggtgaaaccgcctgggattttgggtctgtgggcggactgttcacgagcctaggcaaggcagtgcaccaggtctttgggtcagtttataccacaatgttcggaggcgtgagttggatgatcaggattctaatcggttttctggtgctttggattgggactaattccagaaacaccagcatggccatgacatgcatagctgtaggaggcatcactttgttcctgggttttaccgtccaggccgacatgggctgtgtggtttcttggtcagggcgtgagctcaagtgcggaagtggcattttcgtggtcgataatgtgcatacgtggacagaacaatacaaatttcagcccgagagcccagcacggctggcgtccgctatccttaacgcccacaaggacggggtttgtggaatccgatctaccactagactggagaatgtgatgtggaaacagattacaaacgaattgaattatgtactctgggagggcggtcacgacctgaccgtcgtggcaggggatgtgaagggagtcttaactaaaggcaagagggccctgacccctcccgtttcggacctaaagtacagctggaaaacatggggtaaggctaaaatattcacgccagaagcccgcaactccacctttctcatcgatggccccgacacttcagagtgccctaatgaacggagagcatggaacagtctggaggtggaggattacgggttcggaatgttcacaaccaatatttggatgaagtttagggaaggctctagcgaggtatgtgaccatcgccttatgtccgctgccatcaaagatcagaaggcggtgcacgccgacatggggtattggattgaatcaagcaaaaaccaaacatggcagatcgagaaggcttctttgatagaagtcaagacttgcctgtggccaaaaacccatacgctctggtccaatggagtgctggagagtcagatgttaatcccaaagagctacgcaggccccttctctcagcacaactatcgacaaggttacgccacacagaccgttgggccttggcacctgggaaaacttgagattgattttggcgaatgcccaggtactaccgtgacaatccaggaggactgtgatcatcggggcccctccttgcgtactaccacagcttcagggaagctcgtcacgcagtggtgctgtagaagttgcaccatgcctccactgaggttcctaggagaagacggctgttggtatgggatggagattcgccccctgagcgagaaagaagagaacatggtgaagtcgcaagttgccgcaggacagggcacttccgaaacattttctatgggtctcctgtgccttaccttgttcgtggaggaatgtctgcggagaagggtcactcgaaagcacatgatcttagcggtagtgataacactctgcgccattatcctagggggacttacctggatggatctgttgcgcgctctcattatgctgggcgacacgatgagcggccggatcgggggacagactcatctagccataatggcagtttttaaaatgtcaccgggttacgtgctgggcgtcttcctcagaaagctgaccagtagggagacagctcttatggtgatcgggatggccatgaccactacattgtccattcctcacgacctgatggagttaatcgatggaatttctctcggcctgatccttctgaaaatagtaacccagtttgacaatacacaagtgggtactctagcactcagcctgaccttcattcgttccacgatgtcattggtcatggcctggcgcacaatcatggctgttctgtttgtggtgaccttaatcccactctgtcggactagctgcctgcagaagcagagtcattgggtcgaaattaccgcgcttatcctgggggcccaagcattgcccgtgtatctcatgacactgatgaaaggagcttctagaaggtcctggcctctaaacgagggcattatggccgttggcctggtaagccttctcgggtcggccctgttgaagaatgatgtgcccctggctggaccaatggtcgccggtggattactcctggcagcgtacgtgatgtcagggtctagtgctgacctttccctggaaaaggccgcaaacgttcagtgggatgagatggccgacataactggaagctctcctatcattgaagtgaaacaggatgaggacggcagcttctccatccgagatgtcgaggaaaccaatatgattacgttgctcgtgaagctggctctaatcacagtatcaggtctgtacccccttgcaataccagtcaccatgactctctggtatatgtggcaagtgaaaacacaacggagtggggccctgtgggacgttccgagccctgcggctacccagaaggccgcattgtctgagggagtgtaccgcatcatgcagagaggcttatttggcaaaactcaggtcggggtgggcattcacatggaaggtgttttccacacaatgtggcatgtgaccaggggctccgtcatctgtcacgagacggggcggctggaaccctcatgggccgatgtgcgaaacgacatgattagttatggaggcggttggagactcggggataagtgggacaaggaggaggacgtacaagtgctggctatcgaaccaggcaaaaatcccaagcatgttcagactaaacctggccttttcaagaccctgacaggcgagataggggccgtcaccttggattttaaaccaggaacaagcggttcccccattatcaaccgcaagggcaaagtgatcgggctatacggaaatggcgtggtcactaagtctggtgactatgtatcggcaattacccaggctgaaaggataggggagcctgattacgaggtggacgaagatatcttccgtaagaaacggctgacgattatggacctccacccgggagccggcaagacaaaaagaatcctgccaagcattgttagggaggcgcttaagcgccgattaagaactctgatcctcgcccccacccgggtggtcgcagctgaaatggaggaagccttgaggggcctgcctatacgctatcagacaccagctgtgaaatcagagcataccgggcgtgagatcgttgatctcatgtgccacgcaacttttaccacaagactgctttccagtacgcgggtgcccaactacaatctgattgtcatggacgaagcccacttcactgatccttctagcgtggccgctaggggatacatctccacccgcgtagagatgggtgaagcggcagccatttttatgacagctaccccgcccggcgccactgacccattccctcaatcaaactctcccatcgaggatatagaacgagagattccagagagaagctggaatacagggtttgactggatcaccgactatcagggaaagacggtgtggttcgttcctagtatcaaggcaggcaacgatattgccaattgcttgcggaaatccggtaagaaagtcatccagctaagcaggaagacttttgacacagaataccccaaaaccaagctgaccgattgggacttcgtggtgactacagatatatctgagatgggggctaactttcgcgcgggcagagtcattgacccaaggcggtgtctcaagccggttatcttaaccgatggacctgaacgtgtgattctggccggccccatcccagtaacacccgcatcagctgcccaacgccgagggagaataggaaggaaccctgcacaggaggacgatcagtatgtgttctccggtgacccacttaaaaatgatgaagaccatgcccactggactgaggctaagatgctgctcgataacatttacacgcccgagggcatcatccctaccttgttcgggccggaacgggagaaaacacaggccattgacggagaatttcgcctgagaggcgagcaaaggaagactttcgtcgagctcatgcggcgaggtgacctgccagtgtggcttagttataaagttgcgagcgcagggatctcgtacaaggatagagaatggtgctttaccggcgagcgcaataaccagattctagaagagaatatggaagtggagatatggacaagggagggagaaaagaaaaagctgcggccccgttggttggacgccagagtctatgctgatcctatggccttaaaagacttcaaggagtttgcttctggcaggaaatccatcaccctggatattctcactgaaatcgcaagcctgcccacgtacctttcaagtcgcgccaagctggctctcgacaacatcgtaatgttgcataccacagagagagggggacgagcctaccagcacgcactgaatgaactaccagagtctctggagactctcatgcttgtggcgctgttaggtgccatgaccgctggcattttcttgtttttcatgcaggggacaggaataggcaagctgtccatgggtctcatcaccattgccgttgcaagcgggctgctttgggtggctgaaatccaacctcagtggattgccgcatcaatcatactggagtttttcctcatggtcttgctgatccccgaaccagagaaacagagaactcctcaggataaccaattaatttatgtgatcctaacaattctgacgatcataggcctcattgccgctaatgaaatgggacttatcgagaagaccaaaactgactttggcttctaccaggtcaagacagagaccaccattctggatgtggacttgaggccggcgagtgcctggacactgtatgcagttgctactacgatcctcacccccatgctgcgccacacaatagaaaacactagcgccaatctttccctcgccgcaatcgctaaccaggccgcggtgctgatggggttgggaaaaggctggccactgcatcggatggatttaggtgtacctctactggctatggggtgttactctcaggtgaatcccaccacactcaccgccagccttgtcatgctgttggttcactatgcaattatcggaccaggcctgcaagccaaggctactagagaggcacagaaacgtacggccgcgggtattatgaagaaccctacagtggacggcatcaccgtcatagatctcgaacccatttcctacgacccgaagtttgagaaacagctggggcaagtgatgcttttagtactgtgcgctggacagctcttgctgatgaggactacctgggccttctgtgaggtgctaacactggcaactggcccaatcctcaccctttgggaagggaatcctggacggttctggaacacaacgatcgccgtttcaaccgctaacatttttcgcggctcttatctggccggtgcagggttggctttcagtctgatcaagaatgcccagactccccgaagaggaacaggcaccactggtgagacactcggcgaaaaatggaagaggcagctgaactcgttagaccggaaagagtttgaagagtacaagcgcagcgggatacttgaggtggatagaaccgaagcgaagtccgccctgaaagacggatctaagattaaacatgcagtctcaaggggcagctccaagatccgatggattgtggagcgggggatggtcaaaccaaagggaaaggtggttgatctcggctgcggtcgtgggggatggagttactatatggctacgctcaaaaatgtaaccgaagtgaagggctacacaaaaggcgggcccggacacgaggaacctatcccgatggccacttatggttggaacctggtcaagttgcattctggcgtggacgttttctacaaacccaccgagcaagtggatacactgctctgtgacataggggagagctcatccaatccaactatcgaagagggaagaacccttcgcgtcctgaagatggtggaaccttggttgagtagcaagcccgagttttgcattaaagtactgaacccttatatgccaacagtgatcgaggaactcgagaagttacagaggaaacacggcggtaatctggttcggtgtcccctttctagaaactccacccacgaaatgtactgggtctcaggggcaagcggaaatattgtgtcgtctgtgaacactacgagtaagatgctgctaaatcgcttcacaaccaggcatcgaaaacctacttatgagaaggatgtcgacctcggcgctggcacccggtccgttagcacagaaacggagaaaccagatatgaccatcattgggagaaggctgcagcgcttgcaggaggaacacaaggagacttggcattacgaccaagaaaacccctaccgtacatgggcctatcacggatcatacgaggccccgtccaccggttctgcgagcagtatggtgaatggcgtagtgaagctgctcactaaaccttgggatgtcatcccaatggtgacacagcttgctatgaccgacacaactccctttgggcagcagcgggttttcaaggaaaaagtggacaccagaacgcctcaaccaaagcccggaaccaggatggtcatgacaactaccgcaaactggctgtgggccttactgggcaaaaagaagaatccgcgcttgtgcacacgagaggagtttatatccaaagtgcggagcaacgctgccattggtgcagtattccaggaagaacaggggtggacttctgcctcagaagctgttaatgatagtagattttgggagctcgtggacaaggaaagggcgctgcaccaagagggaaaatgtgagtcctgcgtctataacatgatgggcaagcgcgagaaaaagctaggcgagttcgggagagccaagggaagccgggcaatctggtacatgtggcttggtgctaggtttctggagttcgaggccctcggcttcctgaacgaagatcattggtttgggcgtgaaaattcttggtcgggagtggagggcgaaggtttgcaccgactggggtatatcctcgaggaaattgacaaaaaggatggagaccttatgtacgcagatgacaccgccggctgggatacgcgcataacagaggacgatctgcagaacgaggaattaatcaccgagcagatggctcctcatcacaaaattctggccaaggcgatcttcaaattgacttatcagaataaggtggtcaaggttctcagacccacaccacggggcgcagtgatggacattatctcaaggaaagatcaacgcgggagcggacaggtaggtacctacggcctgaacacttttaccaatatggaagtgcagctaataagacagatggaggccgaaggggtcatcacacaagacgacatgcagaaccctaagggacttaaagagcgggtggagaagtggctgagggaatgcggcgttgatcgactcaaacgtatggctatttccggtgacgattgtgtggtcaagcccctggacgagagattcgggacgagtttgttatttctgaatgatatgggaaaagtgcgcaaggacatcccacagtgggaaccctctaagggctggaaaaactggcaggaggtacctttctgcagccatcactttcacaagattttcatgaaagatggccggtccctcgttgtgccatgtaggaatcaagacgaacttatcgggagagcccgcatatcacagggagcaggttggagtctgcgggagaccgcttgcctaggcaaggcctacgctcagatgtggtctctgatgtattttcataggcgagatctcagattggccagcatggcaatttgttccgcggtcccgactgagtggttccccacatcacggaccacttggagcatccacgcccatcaccagtggatgacaaccgaagacatgctgaaagtgtggaacagggtttggatcgaggataatcctaacatgattgacaagacgccagtgcactcttgggaagacataccctaccttgggaagcgcgaggatctgtggtgcggatccctcatcggcttaagtagccgtgctacatgggccaaaaatattcataccgcaatcactcaagtcagaaacctgattggtaaggaagagtatgtggactacatgcctgtaatgaaacgatattcggctccatccgagtctgaaggggtgttgtga

SEQ ID NO: 15717 - RNA, 9867 nt, synthetic construct
  misc_feature 1..9867: note = derived and/or modified CDS sequence (opt3) from DENV-4__FJ882596__SS-prME
  source 1..9867: mol_type = other RNA
agcaccatcactctgctctgccttattcccactgtgatggccttccacctgtccacgagagacggagagcctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctaatcggttttctggtactttggattgggactaattccagaaacaccagcatggcaatgacatgcatagccgtcggaggcatcactttgttcctgggttttaccgtgcaggctgacatgggctgtgttgtgtcttggtcagggcgtgagctcaagtgcggaagtggcattttcgtcgtggataatgttcatacgtggacagaacaatacaaatttcagcccgagagcccagcccggctggcatccgcgatccttaacgctcacaaggacggggtgtgtggaatccgatctaccactagactggagaatgtaatgtggaaacagattacaaacgaattgaattatgtcctctgggagggcggtcacgacctgaccgtggtggccggggatgtcaggggagttttaactaagggcaaacgcgcactgacccctcccgtgtcggacctaaagtacagctggaagacatggggtaaagccaagatattcacgccagaagctcggaactccacctttctcatcgatggccccgacacttcagagtgccctaatgaaagaagggcctggaacagtctggaggtagaggattacgggttcggaatgttcacaaccaatatttggatgaaatttcgcgaaggctctagcgaggtgtgtgaccatcgacttatgtccgcagctatcaaggatcagaaagccgtccacgcggacatggggtattggattgaatcaagcaagaaccaaacatggcagatcgagaaagcctctttgatagaagtgaagacttgcctgtggccaaagacccatacgctctggtccaatggagttctggagagtcagatgttaatcccgaaaagctacgctggccccttctctcagcacaactatcggcaaggttacgcaacacagaccgtggggccttggcacctgggaaaacttgagattgattttggcgaatgcccaggtactaccgtcacaatccaggaggactgtgatcatcgtggcccctccttgagaactaccacagcctcagggaaactcgtgacgcagtggtgctgtaggagttgcaccatgcctccactgcgcttcctaggagaagacggctgttggtatgggatggagattcggcccctgagcgagaaggaagagaacatggttaaatcgcaagtggctgccggacagggcacttccgaaacattttctatgggtctcctgtgccttaccttgttcgtcgaggaatgtctgagaaggcgagtaactcgcaagcacatgatcttagcagtggttataacactctgcgcgattatcctagggggacttacctggatggatctgttgcgggccctcattatgctgggcgacacgatgagcggcagaatcgggggacagactcatctagctataatggccgtgtttaagatgtcaccgggttacgtcctgggcgtgttcctcaggaaactgaccagtcgtgagacagcacttatggtaatcgggatggctatgaccactacattgtccattcctcacgacctgatggagttaatcgatggaatttctctcggcctgatccttctgaagatagtgacccagtttgacaatacacaagtcggtactctagccctcagcctgaccttcattcgctccacgatgtcattggttatggcatggcggacaatcatggccgtgctgtttgtggtcaccttaatcccactctgtagaactagctgcctgcagaaacagagtcattgggtggaaattaccgctcttatcctgggggcgcaagccttgcccgtttatctcatgacactgatgaagggagcatctaggcgatcctggcctctaaacgagggcattatggctgtaggcctggtgagccttctcgggtcggccctgttgaaaaatgatgtccccctggccggaccaatggtggctggtggcttactcctggcagcctacgttatgtcagggtctagtgcggacctttccctggaaaaggctgccaacgtgcagtgggatgagatggcagacataactggaagctctcctatcattgaagtcaagcaggatgaggacggcagcttctccatccgggatgtggaggaaaccaatatgattacgttgctcgtaaaactggccctaatcacagtctcaggtctgtacccccttgctataccagtgaccatgactctctggtatatgtggcaggttaagacacaacgcagtggggcactgtgggacgtgccgagccctgccgcgacccagaaagctgccttgtctgagggagtctacagaatcatgcagaggggcttatttggcaagactcaggtgggggttggcattcacatggaaggtgtgttccacacaatgtggcatgtcacccggggctccgtgatctgtcacgagacggggcgactggaaccctcatgggcagatgtaagaaacgacatgattagttatggaggcggttggcgcctcggggataaatgggacaaggaggaggacgtgcaagttctggccatcgaaccaggaaagaatcccaaacatgtccagactaagcctggccttttcaaaaccctgacaggcgagataggggctgtgaccttggattttaagccaggaacaagcggttcccccattatcaacaggaaaggcaaggtgatcgggctatacggaaatggcgtcgtaactaaatctggtgactatgtgtcggccattacccaggcagaacgtataggggagcctgattacgaggttgacgaagatatcttccggaagaagagactgacgattatggacctccacccgggagctggcaaaacaaagaggatcctgccaagcattgtgcgcgaggcccttaaacgaagattacggactctgatcctcgcgcccaccagggtcgtggccgcagaaatggaggaggctttgcgcggcctgcctatacgttatcagacaccagccgttaagtcagagcataccgggagagagatcgtggatctcatgtgccacgctacttttaccacacggctgctttccagtacgagggtccccaactacaatctgattgtgatggacgaagcacacttcactgatccttctagcgtagccgcccgcggatacatctccacccgagtggagatgggtgaagctgcggcaatttttatgacagccaccccgcccggcgctactgacccattccctcaatcaaactctcccatcgaggatatagaaagagagattccagagcggagctggaatacagggtttgactggatcaccgactatcagggaaaaacggtttggttcgtccctagtatcaaggccggcaacgatattgcaaattgcttgaggaagtccggtaaaaaggtgatccagctaagccgcaaaacttttgacacagaataccccaagaccaaactgaccgattgggacttcgtggtcactacagatatatctgagatgggggccaactttagagctggcagggttattgacccacggcgttgtctcaagccggtgatcttaaccgatggacctgaacgcgtaattctggcgggccccatcccagtgacacccgcctcagcagctcaacgaagagggaggataggacggaaccctgcccaggaggacgatcagtatgtcttctccggtgacccacttaagaatgatgaagaccatgcacactggactgaggccaaaatgctgctcgataacatttacacgcccgagggcatcatccctaccttgttcgggccggaacgcgagaagacacaggctattgacggagaatttagactgaggggcgagcaacggaaaactttcgtggagctcatgcgaagaggtgacctgccagtttggcttagttataaggtggccagcgcggggatctcgtacaaagatcgcgaatggtgctttaccggcgagaggaataaccagattctagaagagaatatggaagtcgagatatggacacgggagggagaaaagaagaaactgcgtcccagatggttggacgcaagggtatatgccgatcctatggctttaaaggacttcaaagagtttgcctctggccgcaagtccatcaccctggatattctcactgaaatcgctagcctgcccacgtacctttcaagtcgggcaaaactggccctcgacaacatcgtgatgttgcataccacagagcgagggggcagagcttaccagcacgccctgaatgaactaccagagtctctggagactctcatgcttgttgcactgttaggtgcgatgaccgccggcattttcttgtttttcatgcaggggaagggaataggcaagctgtccatgggtctcatcacaattgctgtggccagcgggctgctttgggtcgcagaaatccaacctcagtggattgctgcctcaatcatactggagtttttcctcatggtgttgctgatccccgaaccagagaaacagaggacccctcaggataaccaattaatttatgtcatcctaactattctgacaatcataggcctcattgcagccaatgaaatgggacttatcgagaagacgaaaaccgactttggcttctaccaggtgaagactgagacaaccattctggatgttgacttgcgcccggctagtgcgtggaccctgtatgccgtggcaacaactatcctcacgcccatgctgcggcacaccatagaaaacacaagcgctaatctttccctcgccgccatcgcaaaccaggctgccgtactgatggggttgggaaaaggctggccactgcatagaatggatttaggtgtgcctctactggcgatggggtgttactctcaggtcaatcccactaccctcacagctagccttgttatgctgttggtgcactatgccattatcggaccaggcctgcaagcaaaggccacccgtgaggctcagaaaaggactgcagccggtattatgaagaaccctacggtcgacggcatcacagtgatagatctcgaacccatttcctacgacccgaagtttgagaaacagctggggcaagtaatgcttttagtgctgtgcgcgggacagctcttgctgatgcggaccacttgggctttctgtgaggttctaaccctggccacaggcccaatcctcactctttgggaagggaatcctggacgcttctggaacaccacaatcgcagtgtcaacggccaacatttttcgaggctcttatctggctggtgccgggttggcattcagtctgatcaagaatgctcagacccccagaaggggaactggcacaaccggtgagactctcggcgaaaaatggaagcggcagctgaactcgttagaccgcaaagagtttgaagagtacaagagaagcgggatacttgaggtcgataggacagaagccaagtccgcgctgaaagacggatctaagattaaacatgccgtgtcacgaggcagctccaagatccggtggattgtcgagcgtgggatggtgaaaccaaagggaaaggttgtagatctcggctgcggtagagggggatggagttactatatggcaaccctcaagaatgtgacggaagtcaagggctacaccaaaggcgggcccggacacgaggaacctatcccgatggctacatatggttggaacctggtgaagttgcattctggcgttgacgtgttctacaaacccactgagcaagtcgataccctgctctgtgacataggggagagctcatccaatccaacaatcgaagagggacgcactcttagggtgctgaagatggtagaaccttggttgagtagcaagcccgagttttgcattaaagtgctgaacccttatatgccaaccgttatcgaagaactcgagaagttacagcggaaacacggcggtaatctggtcagatgtcccctttctcgcaactccacacacgaaatgtactgggtgtcaggggccagcggaaatattgtgtcgtctgtcaacaccacaagtaagatgctgctaaataggttcacgacacgacatcggaaacctacctatgagaaggatgttgacctcggcgcaggcactagatccgtgagcaccgaaacagagaaaccagatatgacgatcattgggaggcgcctgcagcgtttgcaggaggaacacaaggagacctggcattacgaccaagaaaacccctaccggacttgggcttatcacggatcatacgaggccccgtccacaggttctgccagcagtatggtaaatggcgtggtcaagctgctcaccaaaccttgggatgtgatcccaatggttactcagcttgcgatgacagacaccacaccctttgggcagcagagagtgttcaaggaaaaagtcgacactaggacccctcaaccaaagcccggaacgcgcatggtgatgaccacaactgctaactggctgtgggcattactgggcaaaaagaagaatccgcgattgtgcacccgggaggagtttatatccaaagtaagaagcaacgccgctattggtgccgttttccaggaagaacaggggtggacatctgcatcagaagccgtgaatgatagtaggttttgggagctcgtcgacaaggaacgcgctctgcaccaagagggaaaatgtgagtcctgcgtgtataacatgatgggcaagagagagaaaaagctaggcgagttcgggcgggcgaagggaagcagggccatctggtacatgtggcttggtgcacgttttctggagttcgaggctctcggcttcctgaacgaagatcattggtttgggcgagaaaattcttggtcgggagtggagggcgaaggtttgcaccgcctggggtatatcctcgaggaaattgacaaaaaggatggagaccttatgtacgccgatgacactgcaggctgggataccagaataacggaggacgatctgcagaacgaggaattaatcacagagcagatggcccctcatcacaaaattctggctaaggccatcttcaaattgacctatcagaataaggtcgttaaggtgctccggcccactccaaggggcgcggtaatggacattatctcacgcaaagatcaaagagggagcggacaggtgggtacatacggcctgaacacctttactaatatggaagtccagctaatacggcagatggaggcagaaggggtgatcacccaagacgacatgcagaaccctaagggacttaaagagagggttgagaagtggctgcgagaatgcggcgtggatcgtctcaaaagaatggccatttccggtgacgattgtgtcgtgaagcccctggacgagcgcttcgggacaagtttgttatttctgaatgatatgggaaaagtacggaaggacatcccacagtgggaaccctctaagggctggaaaaactggcaggaggttcctttctgcagccatcactttcacaagattttcatgaaagatggcaggtccctcgtggtcccatgtagaaatcaagacgaacttatcgggcgcgctcggatatcacagggagccggttggagtctgagggagacggcatgcctaggcaaggcttacgcccagatgtggtctctgatgtattttcatcgaagagatctccggttggctagcatggccatttgttccgcagtgccgaccgagtggttccccacttcaaggacaacctggagcatccacgcgcatcaccagtggatgactacagaagacatgctgaaagtttggaaccgcgtgtggatcgaggataatcctaacatgattgacaagaccccagtccactcttgggaagacataccctaccttgggaagcgtgaggatctgtggtgcggatccctcatcggcttaagtagcagagccacgtgggctaaaaatattcatacagccatcacccaagtgcgaaacctgattggtaaggaagagtatgtagactacatgcctgtgatgaaaaggtattcggcaccatccgagtctgaaggggtcttgtga

SEQ ID NO: 15718 - RNA, 9867 nt, synthetic construct
  misc_feature 1..9867: note = derived and/or modified CDS sequence (opt3) from DENV-4__FJ850059__SS-prME
  source 1..9867: mol_type = other RNA
agcaccataacactgctctgccttattcccactgtgatggccttccacctgtccacgagagacggagagcctttgatgatagtcgctaagcatgaaagggggcggccgttactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagtgtgggtcgaccttgtgttggagcacggcggttgcgtgacaaccatggcccaggggaagcctacgctggattttgaactgactaagacaaccgctaaagaggtcgccctcctgcgcacttactgtatcgaagcgagtatttccaatatcacaaccgcaacgcgatgcccaacccaaggagagccctatcttaaggaggaacaggaccagcagtacatttgtagaagggatgttgtggaccggggctggggcaacgggtgcggactgttcggtaaaggcggggtagtgacatgcgccaagttttcttgtagcggaaaaatcactggcaatttggtccaaatagagaacctcgaatataccgtggttgtgacagtccataatggtgatactcacgctgtggggaacgacacctccaatcacggcgtaacagccaccattactcctcgttcaccaagtgttgaggtgaagctgccggattacggagaattaacgctggactgcgagccccgcagcggcatcgacttcaacgagatgattctcatgaagatgaaaaagaaaacatggcttgtccataagcagtggtttctggatttgcctctaccatggaccgcaggggctgacacttctgaagtgcactggaattacaaagagagaatggtcaccttcaaggtgccccatgccaaaaggcaggatgttacagtgctgggatcccaggaaggtgcgatgcactcagccctcgcaggcgctaccgaggtagacagcggggatggaaaccacatgtttgccggccatctgaagtgtaaggtccggatggaaaaacttcgaatcaagggtatgagttatactatgtgctctgggaaattctccatcgacaaggagatggctgagacacaacacggcacgaccgtggttaaagtgaagtacgaaggagccggcgcaccttgtaaggtcccaattgagatacgcgatgtgaataaagaaaaggtagtggggagagttatcagctcgactcccctggccgagaacacaaactctgtcaccaatattgagttggaaccgcctttcggagactcctatatcgtgataggtgtgggcaactcagctctcacactgcattggtttaggaaagggagtagcattggaaagatgttcgagtccacttaccggggcgcgaaacgcatggcaatcttaggtgaaaccgcctgggattttgggtctgtcggcggactgttcacgagcctaggcaaggctgttcaccaggtgtttgggtcagtgtataccacaatgttcggaggcgtaagttggatgatcaggattctcatcggttttctggtcctttggattgggactaattccagaaacaccagcatggccatgacatgcatagcagtgggaggcatcactttgttcctgggttttaccgttcaggccgacatgggctgtgtggtctcttggtcagggcgtgagctcaagtgcggaagtggcattttcgtggttgataatgtgcatacgtggacagaacaatacaaatttcagcccgagagcccagctcggctggcctccgcaatccttatcgcgcacaaggacggggtatgtggcattcgatctaccactagactggagaacgtcatgtggaaacagataacaaatgaattgaactatgtgctctgggagggcggtcacgacctgaccgtggtcgctggggatgccaagggagttttaactaaaggcaagagggcactgacccctcccgtgtcggacctaaagtacagctggaaaacatggggtaaggccaaaatcttcacgccagaagctcgcaattccacctttctcattgatggccccgacacttcagagtgccctaacgaacggagagcctggaatagtctggaggtagaggattacgggttcggaatgttcacaaccaacatctggatgaagtttagggaaggctctagcgaggtgtgtgaccatcgccttatgtccgcagctattaaagatcagaaggccgtccacgcggacatggggtattggatcgaatcaagcaaaaatcaaacatggcagatagagaaggcctctttgatcgaagtgaagacttgcctgtggccaaaaacccatacgctctggtccaacggagttctggagagtcagatgttaattccaaagagctacgctggccccttctctcagcacaattatcgacaaggttacgcaacacagaccgtggggccttggcacctgggaaaacttgagatcgattttggcgaatgcccaggtactaccgtcacaattcaggaggactgtgatcatcggggcccctccttgcgtactaccacagcctcagggaagctcgtgacgcagtggtgctgtagaagttgcaccatgcctccactgaggttcctaggagaagacggctgttggtatgggatggagatccgccccctgagcgagaaagaagagaacatggttaagtcgcaagtgactgctggacagggcacatccgaaaccttttctatgggtctcctgtgccttactttgttcgtcgaggaatgtctgcggagaagggtaacacgaaagcacatgatattagccgtggttattaccctctgcgcaatcattctagggggacttacgtggatggatctgttgcgcgcgctcatcatgctgggcgacactatgagcggccggatagggggacagacccatctagccatcatggctgtgtttaaaatgtcaccgggttacgtcctgggcgtgttcctcagaaagctgacaagtagggagaccgcccttatggtaattgggatggcaatgactacaaccttgtccatccctcacgacctgatggagttaattgatggaatctctctcggcctgatacttctgaaaattgtgacacagtttgacaacactcaagtcggtaccctagctctcagcctgacgttcatccgttccacaatgtcattggttatggcctggcgcaccatcatggcagtgctgtttgtggtcactttaattccactctgtcggaccagctgcctgcagaagcagagtcattgggtggaaatcacagcccttattctgggggctcaagcgttgcccgtttatctcatgactctgatgaaaggagcctctagaaggtcctggcctctaaatgagggcataatggcagtaggcctggtgagccttctcgggtcggctctgttgaagaacgatgtccccctggccggaccaatggtggccggtggcttactcctggctgcatacgttatgtcagggtctagtgccgacctttccctggaaaaggcggctaatgtgcagtgggatgagatggccgacatcaccggaagctctcctattatcgaagtcaaacaggatgaggacggcagcttctccattcgagatgtggaggaaacgaacatgatcacattgctcgtaaagctggcactaataaccgtctcaggtctgtacccccttgccatcccagtgactatgacactctggtatatgtggcaggttaaaacccaacggagtggggctctgtgggacgtgccgagccctgcagccactcagaaggcggctttgtctgagggagtctaccgcattatgcagagaggcttatttggcaaaacacaggtgggggttggaatccacatggaaggtgtgttccacaccatgtggcatgtcacgaggggctccgtgatttgtcacgagactgggcggctggaaccctcatgggccgatgtacgaaatgacatgatcagttatggaggcggttggagactcggggataagtgggacaaggaggaggacgtgcaagttctggcaatagaaccaggcaaaaaccccaagcatgtccagaccaaacctggccttttcaagacactgaccggcgagattggggccgtgacattggattttaaaccaggaactagcggttcccccatcatcaatcgcaagggcaaagtgattgggctatacggaaacggcgtcgtaaccaagtctggtgactatgtgtcggctataacgcaggccgaaaggatcggggagcctgattacgaggttgacgaagatattttccgtaagaaacggctgacaatcatggacctccacccgggagcaggcaagactaaacggattctgccaagcatcgtgagggaggctcttaagcgccgattaagaaccctgatactcgcccccacacgggtcgtggcggccgaaatggaggaagcattgaggggcctgcctatccgctatcagaccccagctgttaaatcagagcatactgggcgtgagattgtggatctcatgtgccacgccacctttacaacgagactgctttccagtactcgggtccccaattacaacctgatcgtgatggacgaagctcacttcaccgatccttctagcgtagcagccaggggatacatttccacacgcgtggagatgggtgaagccgctgcgatctttatgaccgcaactccgcccggcgccacagacccattccctcaatcaaattctcccatagaggatattgaacgagagatcccagagagaagctggaacaccgggtttgactggatcacggactatcagggaaagactgtttggttcgtccctagtattaaggctggcaatgatatcgccaactgcttgcggaaatccggtaagaaagtgatacagctaagcaggaagacatttgacaccgaataccccaaaaccaagctgactgattgggacttcgtggtcacaaccgatatttctgagatgggggcaaattttcgcgccggcagagttatcgacccaaggcggtgtctcaagccggtgattttaacagatggacctgaacgtgtaatcctggctggccccataccagtgactcccgcgtcagccgcacaacgccgagggagaattggaaggaaccctgctcaggaggacgatcagtatgtcttctccggtgacccacttaaaaacgatgaagaccatgcccactggacggaggcaaagatgctgctcgataatatctacacccccgagggcatcattcctacattgttcgggccggaacgggagaaaactcaggccatcgacggagaatttcgcctgagaggcgagcaaaggaagaccttcgtggagctcatgcggcgaggtgacctgccagtttggcttagttataaagtggctagcgccgggatttcgtacaaggatagagaatggtgctttacaggcgagcgcaacaatcagatactagaagagaacatggaagtcgagatctggaccagggagggagaaaagaaaaagctgcggccccgttggttggacgcgagagtatatgcagatcctatggccttaaaagacttcaaggagtttgcttctggcaggaaatccattactctggatatcctcacggaaatcgccagcctgcccacctacctttcaagtcgcgctaagctggcactcgacaatattgtgatgttgcatacaactgagagagggggacgagcctaccagcacgctctgaacgaactaccagagtctctggagaccctcatgcttgttgccctgttaggtgcaatgacagcgggcatattcttgtttttcatgcaggggaagggaatcggcaaactgtccatgggtctcattaccatcgccgtggctagcgggctgctttgggtcgccgaaattcaacctcagtggatcgcagcttcaataatcctggagtttttcctcatggtgttgctgattcccgaaccagagaagcagagaactcctcaggataatcaattaatctatgtcattctaacaatcctgacgataattggcctcatcgccgcaaacgaaatgggacttattgagaaaaccaagactgactttggcttctaccaggtgaaaacagagaccaccatcctggatgttgacttgaggccggccagtgcttggacactgtatgcggtggccactacgatactcacccccatgctgcgccacacaatcgaaaatactagcgcaaacctttccctcgctgccattgccaatcaggcagctgtactgatggggttgggaaagggctggccactgcatcggatggatttaggtgtgcctctactggccatggggtgttactctcaggtcaaccccaccacactcaccgcgagccttgttatgctgttggtgcactatgctatcattggaccaggcctgcaagccaaagcaactagagaggcccagaagcgtacggctgcaggtatcatgaagaatcctacagtcgacggcataaccgtgattgatctcgaacccatctcctacgacccgaaatttgagaagcagctggggcaagtaatgcttttagtgctgtgcgccggacagctcttgctgatgaggactacctgggcgttctgtgaggttctaacactggctactggcccaatcctcaccctttgggaagggaaccctggacggttctggaatacaacgattgccgtgtcaaccgcaaacatctttcgcggctcttatctggccggtgctgggttggccttcagtctgatcaaaaacgcacagactccccgaagaggaacaggcaccactggtgagacactcggcgaaaagtggaaaaggcagctaaattcgttagaccggaaggagtttgaagagtacaagcgcagcgggattcttgaggtcgatagaaccgaagctaaatccgccctgaaggacggatctaaaatcaagcatgcggtgtcaaggggcagctccaaaattcgatggatcgtcgagcgggggatggtgaagccaaagggaaaagttgtagatctcggctgcggtcgtgggggatggagttactatatggccacgctaaagaacgtgaccgaagtcaaaggctacacaaagggcgggcccggacacgaggaacctataccgatggcaacttatggttggaatctggtgaaattgcattctggcgttgacgtgttctacagacccaccgagcaagtcgatacactgctctgtgacatcggggagagctcatccaacccaactattgaagagggacgcacccttagggtgctgaagatggtagaaccttggttgagtagcaagcccgagttttgcatcaaagtgctgaatccttatatgccaacagttattgaagaactcgagaagttacagcggaaacacggcggtaacctggtcagatgtcccctttctcgcaattccacccacgaaatgtactgggtgtcaggggctagcggaaacatcgtgtcgtctgtcaatactacgagtaagatgctgctaaacaggttcacaacccgacatcggaaacctacttatgagaaggatgttgacctcggcgccggcaccagatccgtgagcacagaaacggagaaaccagatatgaccattatcgggaggcgcctgcagcgtttgcaggaggaacacaaggagacttggcattacgaccaagaaaatccctaccggacatgggcatatcacggatcatacgaggctccgtccaccggttctgccagcagtatggtaaacggcgtggtcaagctgctcactaaaccttgggatgtgataccaatggttacacagcttgccatgaccgacacaactccctttgggcagcagagagtgttcaaggaaaaagtcgacaccaggacgcctcaaccaaagcccggaacccgcatggtgatgacaactaccgcgaattggctgtgggctttactgggcaaaaagaagaacccgcgattgtgcacacgggaggagtttatttccaaagtaagaagcaatgcagccatcggtgctgttttccaggaagaacaggggtggacttctgcctcagaagcagtgaacgatagtaggttttgggagctcgtcgacaaggaacgcgccctgcaccaagagggaaaatgtgagtcctgcgtgtataatatgatgggcaagagagagaaaaagctaggcgagttcgggcgggctaagggaagcagggcgatctggtacatgtggcttggtgcccgttttctggagttcgaggcactcggcttcctgaacgaagatcattggtttgggcgagagaactcttggtcgggagtggagggcgaaggtttgcaccgcctggggtatattctcgaggaaatagacaaaaaggatggagaccttatgtacgctgatgacaccgccggctgggatacgagaatcacagaggacgatctgcagaatgaggaattaattaccgagcagatggcacctcatcacaaaatcctggccaaggctattttcaaattgacttatcagaacaaggtcgttaaggtgctccggcccacaccaaggggcgccgtaatggacatcatatcacgcaaagatcaaagagggagcggacaggtgggtacctacggcctgaatacttttaccaacatggaagtccagctaatccggcagatggaggcggaaggggtgattacacaagacgacatgcagaatcctaagggacttaaagagagggttgagaagtggctgcgagaatgcggcgtggatcgtctcaaaagaatggcaatctccggtgacgattgtgtcgtgaagcccctggacgagcgcttcgggacgagtttgttatttctgaacgatatgggaaaagtacggaaggacattccacagtgggaaccctctaagggctggaaaaattggcaggaggttcctttctgcagccatcactttcacaagatcttcatgaaagatggcaggtccctcgtggtcccatgtagaaaccaagacgaacttatagggcgcgcccggatttcacagggagctggttggagtctgagggagaccgcctgcctaggcaaggcatacgctcagatgtggtctctgatgtattttcatcgaagagatctccggttggccagcatggctatctgttccgccgtgccgactgagtggttccccacatcaaggaccacttggagcatccacgcacatcaccagtggatgacaaccgaagacatgctgaaagtttggaatcgcgtgtggattgaggataaccctaatatgatagacaagacgccagtccactcttgggaagacatcccctaccttgggaagcgtgaggatctgtggtgcggatccctcattggcttaagtagcagagcgacatgggccaaaaacatccataccgctattactcaagtgcgaaatctgatcggtaaggaagagtatgtagactacatgcctgtgatgaaaaggtattcggccccatccgagtctgaaggggtcttgtga

SEQ ID NO: 15719 - RNA, 9867 nt, synthetic construct
  misc_feature 1..9867: note = derived and/or modified CDS sequence (opt3) from DENV-4__FJ882598__SS-prME
  source 1..9867: mol_type = other RNA
agcaccatcactctgctctgccttattcccactgccatggctttccacctgtccacgcgggacggcgagcctttgatgatagtggcaaagcatgaaagggggcggccgttactgtttaaaaccaccgagggaatcaacaagtgtactctgattgccatggatctcggtgaaatgtgcgaggacaccgtcacatacaaatgtccgctgcttgttaataccgaacccgaggatatcgactgctggtgtaacctgacttctacatgggtgatgtatggaacctgcacgcagtcaggggagcgccgacgtgaaaagagaagtgtagcgttgactcctcacagcggaatgggcctcgagaccagggctgaaacatggatgtcctctgagggtgcctggaaacatgcacagcgggtggagtcgtggattctgcgcaatccagggttcgccctgctcgctggatttatggcatacatgatcggccagactggcatacagagaaccgtcttctttgtgttaatgatgctggttgccccctcatatgggatgaggtgtgtgggagtcggtaaccgggatttcgtggaaggcgtaagcgggggagcttgggttgaccttgtgttggagcacggcggttgcgtcacaaccatggcccaggggaagcctacgctggattttgaactaactaagacaaccgcgaaagaggtggcactcctgcgcacttactgtatcgaagccagtatttccaatatcacaaccgctacgcgatgcccaacccaaggagagccctatcttaaggaggaacaggaccagcagtacatttgtagaagggatgtggtcgaccggggctggggcaacgggtgcggactgttcggtaaaggcggggttgtgacatgcgccaagttttcttgtagcggaaaaatcactggcaatttggtacaaatagagaacctcgaatataccgtggtcgtgacagttcataatggtgatactcacgcagtggggaacgacacctccaatcacggcgtcacagctaccattactcctcgttcaccaagtgtggaggtaaagctgccggattacggagaattaacgctggactgcgagccccgcagcggcatcgacttcaacgagatgattctcatgaagatgaaaaagaaaacatggcttgttcataagcagtggtttctggatttgcctctaccatggaccgccggggcggacacttctgaagtgcactggaattacaaagagagaatggtcaccttcaaggtgccccatgccaaaaggcaggatgtcacagtgctgggatcccaggaaggtgcaatgcactcagctctcgccggcgctaccgaggttgacagcggggatggaaaccacatgtttgccggccatctgaagtgtaaggtgcggatggaaaaacttcgaatcaagggtatgagttatactatgtgctctgggaaattctccatcgacaaggagatggcagagacacaacacggcacgaccgtagtcaaagtgaagtacgaaggagccggcgctccttgtaaggttccaattgagatacgcgatgtgaataaagaaaaggtcgtggggagagtaatcagctcgactcccctggcggagaacacaaactctgtgaccaatattgagttggaaccgcctttcggagactcctatatcgttataggtgtcggcaactcagcactcacactgcattggtttaggaaagggagtagcattggaaagatgttcgagtccacttaccggggcgccaaacgcatggctatcttaggtgaaaccgcctgggattttgggtctgtgggcggactgttcacgagcctaggcaaggcagtgcaccaggtctttgggtcagtttataccacaatgttcggaggcgtgagttggatgatcaggattctcatcggttttctggtgctttggattgggactaattccagaaacaccagcatggccatgacatgcatagctgtaggaggcatcactttgttcctgggttttaccgtccaggccgacatgggctgtgtggtttcttggtcagggcgtgagctcaagtgcggaagtggcattttcgtggtcgataatgtgcatacgtggacagaacaatacaaatttcagcccgagagcccagcacggctggcgtccgctatccttaacgcccacaaggacggggtttgtggaatccgatctaccactagactggagaatgtgatgtggaaacagattacaaacgaattgaattatgtactctgggagggcggtcacgacctgaccgtcgtggcaggggatgtgaagggagtcttaactaaaggcaagagggccctgacccctcccgtttcggacctaaagtacagctggaaaacatggggtaaggctaaaatattcacgccagaagcccgcaactccacctttctcatcgatggccccgacacttcagagtgccctaatgaacggagagcatggaacagtctggaggtggaggattacgggttcggaatgttcacaaccaatatttggatgaagtttagggaaggctctagcgaggtatgtgaccatcgccttatgtccgctgccatcaaagatcagaaggcggtgcacgccgacatggggtattggattgaatcaagcaaaaaccaaacatggcagatcgagaaggcttctttgatagaagtcaagacttgcctgtggccaaaaacccatacgctctggtccaatggagtgctggagagtcagatgttaatcccaaagagctacgcaggccccttctctcagcacaactatcgacaaggttacgccacacagaccgttgggccttggcacctgggaaaacttgagattgattttggcgaatgcccaggtactaccgtgacaatccaggaggactgtgatcatcggggcccctccttgcgtactaccacagcttcagggaagctcgtcacgcagtggtgctgtagaagttgcaccatgcctccactgaggttcctaggagaagacggctgttggtatgggatggagattcgccccctgagcgagaaagaagagaacatggtgaagtcgcaagttgccgcaggacagggcacttccgaaacattttctatgggtctcctgtgccttaccttgttcgtggaggaatgtctgcggagaagggtcactcgaaagcacatgatcttagcggtagtgataacactctgcgccattatcctagggggacttacctggatggatctgttgcgcgctctcattatgctgggcgacacgatgagcggccggatcgggggacagactcatctagccataatggcagtttttaaaatgtcaccgggttacgtgctgggcgtcttcctcagaaagctgaccagtagggagacagctcttatggtgatcgggatggccatgaccactacattgtccattcctcacgacctgatggagttaatcgatggaatttctctcggcctgatccttctgaaaatagtaacccagtttgacaatacacaagtgggtactctagcactcagcctgaccttcattcgttccacgatgtcattggtcatggcctggcgcacaatcatggctgttctgtttgtggtgaccttaatcccactctgtcggactagctgcctgcagaagcagagtcattgggtcgaaattaccgcgcttatcctgggggcccaagcattgcccgtgtatctcatgacactgatgaaaggagcttctagaaggtcctggcctctaaacgagggcattatggccgttggcctggtaagccttctcgggtcggccctgttgaagaatgatgtgcccctggctggaccaatggtcgccggtggattactcctggcagcgtacgtgatgtcagggtctagtgctgacctttccctggaaaaggccgcaaacgttcagtgggatgagatggccgacataactggaagctctcctatcattgaagtgaaacaggatgaggacggcagcttctccatccgagatgtcgaggaaaccaatatgattacgttgctcgtgaagctggctctaatcacagtatcaggtctgtacccccttgcaataccagtcaccatgactctctggtatatgtggcaagtgaaaacacaacggagtggggccctgtgggacgttccgagccctgcggctacccagaaggccgcattgtctgagggagtgtaccgcatcatgcagagaggcttatttggcaaaactcaggtcggggtgggcattcacatggaaggtgttttccacacaatgtggcatgtgaccaggggctccgtcatctgtcacgagacggggcggctggaaccctcatgggccgatgtgcgaaacgacatgattagttatggaggcggttggagactcggggataagtgggacaaggaggaggacgtacaagtgctggctatcgaaccaggcaaaaatcccaagcatgttcagactaaacctggccttttcaagaccctgacaggcgagataggggccgtcaccttggattttaaaccaggaacaagcggttcccccattatcaaccgcaagggcaaagtgatcgggctatacggaaatggcgtggtcactaagtctggtgactatgtatcggcaattacccaggctgaaaggataggggagcctgattacgaggtggacgaagatatcttccgtaagaaacggctgacgattatggacctccacccgggagccggcaagacaaaaagaatcctgccaagcattgttagggaggcgcttaagcgccgattaagaactctgatcctcgcccccacccgggtggtcgcagctgaaatggaggaagccttgaggggcctgcctatacgctatcagacaccagctgtgaaatcagagcataccgggcgtgagatcgttgatctcatgtgccacgcaacttttaccacaagactgctttccagtacgcgggtgcccaactacaatctgattgtcatggacgaagcccacttcactgatccttctagcgtggccgctaggggatacatctccacccgcgtagagatgggtgaagcggcagccatttttatgacagctaccccgcccggcgccactgacccattccctcaatcaaactctcccatcgaggatatagaacgagagattccagagagaagctggaatacagggtttgactggatcaccgactatcagggaaagacggtgtggttcgttcctagtatcaaggcaggcaacgatattgccaattgcttgcggaaatccggtaagaaagtcatccagctaagcaggaagacttttgacacagaataccccaaaaccaagctgaccgattgggacttcgtggtgactacagatatatctgagatgggggctaactttcgcgcgggcagagtcattgacccaaggcggtgtctcaagccggttatcttaaccgatggacctgaacgtgtgattctggccggccccatcccagtaacacccgcatcagctgcccaacgccgagggagaataggaaggaaccctgcacaggaggacgatcagtatgtgttctccggtgacccacttaaaaatgatgaagaccatgcccactggactgaggctaagatgctgctcgataacatttacacgcccgagggcatcatccctaccttgttcgggccggaacgggagaaaacacaggccattgacggagaatttcgcctgagaggcgagcaaaggaagactttcgtcgagctcatgcggcgaggtgacctgccagtgtggcttagttataaagttgcgagcgcagggatctcgtacaaggatagagaatggtgctttaccggcgagcgcaataaccagattctagaagagaatatggaagtggagatatggacaagggagggagaaaagaaaaagctgcggccccgttggttggacgccagagtctatgctgatcctatggccttaaaagacttcaaggagtttgcttctggcaggaaatccatcaccctggatattctcactgaaatcgcaagcctgcccacgtacctttcaagtcgcgccaagctggctctcgacaacatcgtaatgttgcataccacagagagagggggacgagcctaccagcacgcactgaatgaactaccagagtctctggagactctcatgcttgtggcgctgttaggtgccatgaccgctggcattttcttgtttttcatgcaggggaagggaataggcaaactgtccatgggtctcatcacaattgccgttgcaagcgggctgctttgggtggctgaaatccaacctcagtggattgccgcatcaatcatactggagtttttcctcatggtcttgctgatccccgaaccagagaagcagagaacccctcaggataaccaattaatttatgtgatcctaactattctgacaatcataggcctcattgccgctaatgaaatgggacttatcgagaaaacgaagaccgactttggcttctaccaggtcaaaactgagacaaccattctggatgtggacttgaggccggcgagtgcctggaccctgtatgcagttgctacaactatcctcacgcccatgctgcgccacaccatagaaaacacaagcgccaatctttccctcgccgcaatcgctaaccaggccgcggtgctgatggggttgggaaagggctggccactgcatcggatggatttaggtgtacctctactggctatggggtgttactctcaggtgaatcccactaccctcacagccagccttgtcatgctgttggttcactatgcaattatcggaccaggcctgcaagccaaagctaccagagaggcacagaagcgtactgccgcgggtattatgaagaaccctacggtggacggcatcacagtcatagatctcgaacccatttcctacgacccgaaatttgagaagcagctggggcaagtgatgcttttagtactgtgcgctggacagctcttgctgatgaggaccacttgggccttctgtgaggtgctaaccctggcaacaggcccaatcctcactctttgggaagggaatcctggacggttctggaacaccacaatcgccgtttcaacggctaacatttttcgcggctcttatctggccggtgcagggttggctttcagtctgatcaaaaatgcccagacaccccgaagaggaactggcacaaccggtgagactctcggcgaaaagtggaaaaggcagctgaactcgttagaccggaaggagtttgaagagtacaagcgcagcgggatacttgaggtggatagaacagaagcgaaatccgccctgaaggacggatctaaaattaagcatgcagtctcaaggggcagctccaaaatccgatggattgtggagcgggggatggtcaagccaaagggaaaagtggttgatctcggctgcggtcgtgggggatggagttactatatggctaccctaaagaatgtaacggaagtgaaaggctacaccaagggcgggcccggacacgaggaacctatcccgatggccacatatggttggaacctggtcaaattgcattctggcgtggacgttttctacaagcccactgagcaagtggataccctgctctgtgacataggggagagctcatccaatccaacaatcgaagagggaagaactcttcgcgtcctgaagatggtggaaccttggttgagtagcaaacccgagttttgcattaaggtactgaacccttatatgccaaccgtgatcgaggaactcgagaaattacagaggaagcacggcggtaatctggttcggtgtcccctttctagaaactccacacacgaaatgtactgggtctcaggggcaagcggaaatattgtgtcgtctgtgaacaccacaagtaaaatgctgctaaatcgcttcacgacaaggcatcgaaagcctacctatgagaaagatgtcgacctcggcgctggcactcggtccgttagcaccgaaacagagaagccagatatgacgatcattgggagaaggctgcagcgcttgcaggaggaacacaaggagacctggcattacgaccaagaaaacccctaccgtacttgggcctatcacggatcatacgaggccccgtccacaggttctgcgagcagtatggtgaatggcgtagtgaaactgctcaccaagccttgggatgtcatcccaatggtgactcagcttgctatgacagacaccacaccctttgggcagcagcgggttttcaaagaaaaggtggacactagaacccctcaaccaaaacccggaacgaggatggtcatgaccacaactgcaaactggctgtgggccttactgggcaagaagaaaaatccgcgcttgtgcacccgagaggagtttatatccaaggtgcggagcaacgctgccattggtgcagtattccaggaggaacaggggtggacatctgcctcagaagctgttaatgatagtagattttgggagctcgtggacaaagaaagggcgctgcaccaagagggaaagtgtgagtcctgcgtctataacatgatgggcaaacgcgaaaagaagctaggcgagttcgggagagccaaaggaagccgggcaatctggtacatgtggcttggtgctaggtttctggagttcgaggccctcggcttcctgaacgaagatcattggtttgggcgtgaaaattcttggtcgggagtggagggcgaaggtttgcaccgactggggtatatcctcgaggaaattgacaagaaagatggagaccttatgtacgcagatgacactgccggctgggatacccgcataacggaggacgatctgcagaacgaggaattaatcacagagcagatggctcctcatcacaagattctggccaaagcgatcttcaagttgacctatcagaataaggtggtcaaagttctcagacccactccacggggcgcagtgatggacattatctcaaggaaggatcaacgcgggagcggacaggtaggtacatacggcctgaacacctttactaatatggaagtgcagctaataagacagatggaggccgaaggggtcatcacccaagacgacatgcagaaccctaaaggacttaaggagcgggtggagaaatggctgagggaatgcggcgttgatcgactcaagcgtatggctatttccggtgacgattgtgtggtcaaacccctggacgagagattcgggacaagtttgttatttctgaatgatatgggaaaggtgcgcaaggacatcccacagtgggaaccctctaaaggctggaagaactggcaggaggtacctttctgcagccatcactttcacaaaattttcatgaaggatggccggtccctcgttgtgccatgtaggaatcaagacgaacttatcgggagagcccgcatatcacagggagcaggttggagtctgcgggagacggcttgcctaggcaaagcctacgctcagatgtggtctctgatgtattttcataggcgagatctcagattggccagcatggcaatttgttccgcggtcccgaccgagtggttccccacttcacggacaacctggagcatccacgcccatcaccagtggatgactacagaagacatgctgaaggtgtggaacagggtttggatcgaggataatcctaacatgattgacaagaccccagtgcactcttgggaagacataccctaccttgggaaacgcgaggatctgtggtgcggatccctcatcggcttaagtagccgtgctacgtgggccaagaatattcatacagcaatcacccaagtcagaaacctgattggtaaagaagagtatgtggactacatgcctgtaatgaagcgatattcggctccatccgagtctgaaggggtgttgtga

SEQ ID NO: 15720 - RNA, 9867 nt, synthetic construct
  misc_feature 1..9867: note = derived and/or modified CDS sequence (opt3) from DENV-4__FJ882601__SS-prME
  source 1..9867: mol_type = other RNA
agcaccatcactctgctctgccttattcccactgtgatggccttccacctgtccacgagagacggagagcctttgatgatagtcgctaagcatgaaagggggcggccgttactgtttaaaaccaccgagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctcatcggttttctggtactttggattgggactaattccagaaacaccagcatggcaatgacatgcatagccgtcggaggcatcactttgttcctgggttttaccgtgcaggctgacatgggctgtgttgtgtcttggtcagggcgtgagctcaagtgcggaagtggcattttcgtcgtggataatgttcatacgtggacagaacaatacaaatttcagcccgagagcccagcccggctggcatccgcgatccttaacgctcacaaggacggggtgtgtggaatccgatctaccactagactggagaatgtaatgtggaaacagattacaaacgaattgaattatgtcctctgggagggcggtcacgacctgaccgtggtggccggggatgtcaagggagttttaactaaaggcaagagggcactgacccctcccgtgtcggacctaaagtacagctggaaaacatggggtaaggccaaaatattcacgccagaagctcgcaactccacctttctcatcgatggccccgacacttcagagtgccctaatgaacggagagcctggaacagtctggaggtagaggattacgggttcggaatgttcacaaccaatatttggatgaagtttagggaaggctctagcgaggtgtgtgaccatcgccttatgtccgcagctatcaaagatcagaaggccgtccacgcggacatggggtattggattgaatcaagcaaaaaccaaacatggcagatcgagaaggcctctttgatagaagtgaagacttgcctgtggccaaaaacccatacgctctggtccaatggagttctggagagtcagatgttaatcccaaagagctacgctggccccttctctcagcacaactatcgacaaggttacgcaacacagaccgtggggccttggcacctgggaaaacttgagattgattttggcgaatgcccaggtactaccgtcacaatccaggaggactgtgatcatcggggcccctccttgcgtactaccacagcctcagggaagctcgtgacgcagtggtgctgtagaagttgcaccatgcctccactgaggttcctaggagaagacggctgttggtatgggatggagattcgccccctgagcgagaaagaagagaacatggttaagtcgcaagtggctgccggacagggcacttccgaaacattttctatgggtctcctgtgccttaccttgttcgtcgaggaatgtctgcggagaagggtaactcgaaagcacatgatcttagcagtggttataacactctgcgcgattatcctagggggacttacctggatggatctgttgcgcgccctcattatgctgggcgacacgatgagcggccggatcgggggacagactcatctagctataatggccgtgtttaaaatgtcaccgggttacgtcctgggcgtgttcctcagaaagctgaccagtagggagacagcacttatggtaatcgggatggctatgaccactacattgtccattcctcacgacctgatggagttaatcgatggaatttctctcggcctgatccttctgaaaatagtgacccagtttgacaatacacaagtcggtactctagccctcagcctgaccttcattcgttccacgatgtcattggttatggcatggcgcacaatcatggccgtgctgtttgtggtcaccttaatcccactctgtcggactagctgcctgcagaagcagagtcattgggtggaaattaccgctcttatcctgggggcgcaagccttgcccgtttatctcatgacactgatgaaaggagcatctagaaggtcctggcctctaaacgagggcattatggctgtaggcctggtgagccttctcgggtcggccctgttgaagaatgatgtccccctggccggaccaatggtggctggtggcttactcctggcagcctacgttatgtcagggtctagtgcggacctttccctggaaaaggctgccaacgtgcagtgggatgagatggcagacataactggaagctctcctatcattgaagtcaaacaggatgaggacggcagcttctccatccgagatgtggaggaaaccaatatgattacgttgctcgtaaagctggccctaatcacagtctcaggtctgtacccccttgctataccagtgaccatgactctctggtatatgtggcaggttaaaacacaacggagtggggcactgtgggacgtgccgagccctgccgcgacccagaaggctgccttgtctgagggagtctaccgcatcatgcagagaggcttatttggcaaaactcaggtgggggttggcattcacatggaaggtgtgttccacacaatgtggcatgtcaccaggggctccgtgatctgtcacgagacggggcggctggaaccctcatgggcagatgtacgaaacgacatgattagttatggaggcggttggagactcggggataagtgggacaaggaggaggacgtgcaagttctggccatcgaaccaggcaagaatcccaagcatgtccagactaaacctggccttttcaagaccctgacaggcgagataggggctgtgaccttggattttaaaccaggaacaagcggttcccccattgtgaaccgcaagggcaaagtcatcgggctatacggaaatggcgtagtgactaagtctggtgactatgtttcggccatcacccaggcagaaaggattggggagcctgattacgaggtggacgaagatatattccgtaagaaacggctgacgatcatggacctccacccgggagctggcaagacaaaacggattctgccaagcatcgtcagggaggcccttaagcgccgattaagaactctgattctcgcgcccacccgggtggttgccgcagaaatggaggaggctttgaggggcctgcctatccgctatcagacaccagccgtgaaatcagagcataccgggcgtgagatagtcgatctcatgtgccacgctacttttaccacaagactgctttccagtacgcgggtgcccaactacaatctgatcgtaatggacgaagcacacttcactgatccttctagcgtggccgccaggggatacatttccacccgcgttgagatgggtgaagctgcggcaatctttatgacagccaccccgcccggcgctactgacccattccctcaatcaaactctcccattgaggatatcgaacgagagataccagagagaagctggaatacagggtttgactggattaccgactatcagggaaagacggtctggttcgtgcctagtatcaaggccggcaacgatatcgcaaattgcttgcggaaatccggtaagaaagtgattcagctaagcaggaagacttttgacacagaataccccaaaaccaagctgaccgattgggacttcgtcgttactacagatatctctgagatgggggccaactttcgcgctggcagagtgatagacccaaggcggtgtctcaagccggtaattttaaccgatggacctgaacgtgtgatcctggcgggccccattccagtcacacccgcctcagcagctcaacgccgagggagaatcggaaggaaccctgcccaggaggacgatcagtatgtgttctccggtgacccacttaaaaatgatgaagaccatgcacactggactgaggccaagatgctgctcgataacatatacacgcccgagggcattatccctaccttgttcgggccggaacgggagaaaacacaggctatcgacggagaatttcgcctgagaggcgagcaaaggaagactttcgttgagctcatgcggcgaggtgacctgccagtgtggcttagttataaagtcgccagcgcggggatttcgtacaaggatagagaatggtgctttaccggcgagcgcaataaccagatcctagaagagaatatggaagtagagatttggacaagggagggagaaaagaaaaagctgcggccccgttggttggacgcaagagtgtatgccgatcctatggctttaaaagacttcaaggagtttgcctctggcaggaaatccataaccctggatatcctcactgaaattgctagcctgcccacgtacctttcaagtcgcgcaaagctggccctcgacaacatcgttatgttgcataccacagagagagggggacgagcttaccagcacgccctgaatgaactaccagagtctctggagactctcatgcttgtggcactgttaggtgcgatgaccgccggcatcttcttgtttttcatgcaggggaagggaattggcaaactgtccatgggtctcataacaatcgctgtcgccagcgggctgctttgggtggcagaaattcaacctcagtggatcgctgcctcaattatcctggagtttttcctcatggtcttgctgatacccgaaccagagaagcagagaacccctcaggataaccaattaatctatgtgattctagcaatcctgactattatcggcctcatagccgctaatgaaatgggacttattgagaaaacaaagacggactttggcttctaccaggagaaaaccgaaactacaatcctggatgttgacttgaggccggcgagtgcctggaccctgtatgcagtggctaccacaattctcactcccatgctgcgccacacgatcgagaacaccagcgccaatctttccctcacagccatagcaaaccaggctgccgtactgatggggttgggaaagggctggccactgcatcggatggatttaggtgtgcctctactggcgatggggtgttactctcaggtcaatcccactaccctcacagctagccttgttatgctgttggtgcactatgccatcattggaccaggcctgcaagcaaaagccaccagagaagctctcaagcgtactgcagccggtatcatgaagaaccctacggtcgacggcattacagtgatcgatctggagcccatatcctacgacccgaaatttgagaagcagcttgggcaggtaatgttactggtgctctgcgcgggacaattgctgctaatgaggaccacttgggctttctgtgaagttctgaccctcgccacaggcccaattcttactctgtgggaggggaatcctggacggttctggaacaccacaatcgcagtgtcaacggccaacatctttcgcggctcttatttggctggtgccgggctggcattcagtctcattaaaaatgtccagacaccccgaagaggaactggcacaaccggtgaaactctgggcgagaagtggaaaaggcagttaaactcgcttgaccggaaggaatttgaggagtacaagcgcagcgggatcctggaagtggatagaacagaggctaaatccgccctcaaggacggatctaaaataaagcatgcggtctcaaggggcagctccaaaattcgatggatcgtggaacgggggatggttaagccaaagggaaaagtagtggatctaggctgcggtcgtgggggatggagttactatatggccaccctgaagaatgtcacggaggtgaaaggctacaccaagggcgggcccggacacgaggaacctattccgatggcaacatatggttggaacttggttaaactgcattctggcgtggacgtcttctacaagcccactgaacaggtggataccctcctttgtgacatcggggaaagctcatccaatccaacaatagaggaaggaagaactctgcgcgtattgaagatggtggagccttggctgagtagcaaacccgaattttgcatcaaggttctcaacccttatatgccaaccgtcattgaggagttagaaaaactgcaaaggaagcacggcggtaatcttgtgcggtgtcccctgtctagaaactccacacacgagatgtactgggtgtcaggggctagcggaaatatcgtctcgtctgttaacaccacaagtaaaatgctactcaatcgcttcacgacaaggcatcgaaagcctacctatgaaaaagatgtggacctgggcgccggcactcggtccgtaagcaccgagacagagaagccagatatgacgattatcgggagaaggttgcagcgcctgcaggaggaacacaaggaaacctggcattacgaccaggagaacccctaccgtacttgggcatatcacggatcatacgaagctccgtccacaggttctgccagcagtatggtgaatggcgtcgtgaaactccttaccaagccttgggatgttattccaatggtgactcaactggccatgacagacaccacaccctttgggcagcagcgggtcttcaaagagaaggtggacactagaacccctcagccaaaacccggaacgaggatggtaatgaccacaactgcgaactggttatgggctctgttgggcaagaagaaaaatccgcgcctctgcacccgagaggaatttatctccaaggttcggagcaacgcagccataggtgctgtgttccaagaggaacaggggtggacatctgcctcagaggcagtcaatgatagtagattttgggaactggtggacaaagagagggccctacaccaggagggaaagtgtgaatcctgcgtgtataacatgatgggcaaacgcgagaagaaacttggcgagttcgggagagctaaaggaagccgggcgatttggtacatgtggctgggtgccaggtttctcgagttcgaagcactgggcttcttgaacgaggatcattggtttgggcgtgaaaattcttggtcgggagtcgaaggcgagggtctgcaccgactcgggtatatccttgaagagatcgacaagaaagatggagacctgatgtacgctgatgacactgccggctgggatacccgcattacggaggacgatttacaaaacgaggaactggttacagaacagatggcacctcatcacaagatattggccaaagctatcttcaagctcacctatcagaataaggtggtaaaagtgctgagacccactccacggggcgccgtcatggacattatctcaaggaaggatcagcgcgggagcggacaagtgggtacatacggcctaaacacctttactaatatggaggttcagcttattagacagatggaagcggagggggtgatcacccaggacgacatgcaaaaccctaaaggactgaaggagcgggtcgaaaaatggctcagggagtgcggcgtggatcgactgaagcgtatggcaatatccggtgacgattgtgtagttaaacccttggacgaaagattcgggacaagtttactgtttctcaatgatatgggaaaggtgcgcaaggacatcccacagtgggagccctctaaaggctggaagaactggcaggaagtccctttctgcagccatcactttcacaaaattttcatgaaggatggccggtcccttgtggttccatgtaggaatcaggacgagctgatcgggagagcccgcatttcacaaggagctggttggagtctacgggagacggcctgcctgggcaaagcatacgctcagatgtggtctctcatgtattttcataggcgagatttgagactggccagcatggctatctgttccgccgtgccgaccgaatggttccccacttcacggacaacctggagcatacacgcacatcaccagtggatgactacagaggacatgcttaaggtctggaacagggtgtggattgaagataatcctaacatgatcgacaagaccccagtacactcttgggaggacatcccctacctggggaaacgcgaagatctctggtgcggatccttaattggcctgagtagccgtgcgacgtgggccaagaatatacatacagctatcacccaggtgagaaacttgattggtaaagaggagtatgtcgactacatgcctgttatgaagcgatattcggccccatccgaatctgagggggtgctgtga

SEQ ID NO: 15721 - RNA, 9867 nt, synthetic construct
  misc_feature 1..9867: note = derived and/or modified CDS sequence (opt3) from DENV-4__FJ226067__SS-prME
  source 1..9867: mol_type = other RNA
agcaccatcaccctgctctgccttattcccactgtgatggccttccacctgtccacgagagacggcgagcctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtgatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggcgggggagtagcattggaaaaatgttcgagtccacttaccgcggcgcaaagagaatggccatcttaggtgaaaccgcttgggattttgggtctgtgggcggactgttcacgagcctaggcaaagccgtccaccaggtttttgggtcagtgtataccacaatgttcggaggcgtgagttggatgatcaggattctcatcggttttctggtactttggattgggactaattcccgtaacaccagcatggcaatgacatgcataactgtcggaggcatcaccttgttcctgggttttacggtgcaggccgacatgggctgtgttgtgtcttggtcagggcgggagctcaagtgcggaagtggcattttcgtcgtggataatgttcatacatggaccgaacaatacaagtttcagcccgagagcccagctcgactggcctccgcaatccttaacgcgcacaaagacggggtgtgtggaatcagatctactacaaggctggagaatgtaatgtggaagcagattaccaacgaattgaattatgctctctgggagggcggtcacgacctgactgtcgtggccggggatgtgaaaggagtcttaaccaagggcaaacgcgcactgacacctcccgtttcggacctaaagtacagctggaagacgtggggtaaagccaagatattcaccccagaagctcggaactccacttttctcatcgatggccccgacacatcagagtgccctaatgaaagaagggcctggaacagtctggaggtggaggattacgggttcggaatgttcaccacaaatatttggatgaaatttcgcgaaggctctagcgaggtatgtgaccatcgacttatgtccgcagctatcaaggatcagaaagccgtgcacgcggacatggggtattggattgaatcaagcaagaaccaaacttggcagatcgagaaagcctctttgatagaagtcaagacctgcctgtggccaaagacgcatacactctggtccaatggagtgctggagagtcagatgttaatcccgaaaagctacgctggccccttctctcagcacaactatcggcaaggttacgcaacccagactgttgggccttggcacctgggaaaacttgagattgattttggcgaatgcccaggtaccacagtgactatccaggaggactgtgatcatcgtggcccctccttgagaaccacaacggcctcagggaaactcgtcacccagtggtgctgtaggagttgcactatgcctccactgcgcttcctaggagaagacggctgttggtatgggatggagattcggcccctgagcgagaaggaagagaacatggtgaaatcgcaagttacagctggacagggcacctccgaaactttttctatgggtctcctgtgccttacattgttcgtggaggaatgtctgagaaggcgagtcacccgcaagcacatgatcttagtagtggttataacgctctgcgccattatcctagggggacttacttggatggatctgttgcgggcactcattatgctgggcgacaccatgagcggcagaatcgggggacagatacatctagcgatcatggccgtgtttaagatgtcaccgggttacgtcctgggcgtgttcctcaggaaactgacaagtcgtgagaccgctcttatggtaattgggatggccatgactacagtgttgtccatccctcacgacctgatggagttaattgatggaatctctctcggcctgatacttctgaagattgtcacccagtttgacaatacacaagttggtactctagcactcagcctgaccttcatccgctccacgatgccattggtgatggcttggcggacaatcatggccgtgctgtttgtcgtgaccttaattcccctctgtagaacttcatgcctgcagaaacagagccattgggttgaaatcaccgcacttattctgggggcccaggctttgcctgtatatctcatgacactgatgaagggagcgagtaggcgatcttggcccctaaacgagggcataatggccgtgggcctggtctcccttctcgggagcgcactgttgaaaaatgatgtgccactggctggacctatggttgccggtggcttactcctggccgcttacgtgatgtcggggtcatctgcagaccttagtctggaaaaggccgcgaacgtccagtgggatgagatggctgacatcactggatccagccccattatcgaagtgaagcaggatgaggacggctctttcagcattcgggatgtagaggaaaccaatatgatcacgttgctcgtcaaactggccctaataacagtgtccggtctgtacccacttgcaatcccggttaccatgactctctggtatatgtggcaagtgaagacacaacgctcaggggccctgtgggacgtccctagtcccgctgcaacccagaaagccgcgttgagcgagggagtgtacagaattatgcagaggggcttatttggcaagactcaggttggggtgggaatccacatggaaggtgtcttccacacaatgtggcatgtgacccggggctctgtaatttgtcacgagacggggcgactggaaccatcctgggctgatgtgagaaacgacatgatctcatatggaggcggttggcgcctcggggataaatgggacaaggaggaggacgttcaagtcctggccatagaacccggaaagaatcctaaacatgtgcagactaagccaggccttttcaaaaccctgacaggcgagattggggcagtgaccttggattttaagcccggaacaagtggtagccctatcatcaacaggaaaggcaaggtcattgggctatacggaaatggcgtagtgactaaatccggtgactatgtttctgccataacccaggctgaacgtatcggggagccggattacgaggtggacgaagatattttccggaagaagagactgacgatcatggacctccacccaggagccggcaaaacaaagaggattctgccctcgatcgtccgcgaggcacttaaacgaagattacggactctgatactcgctcctaccagggtggttgccgcggaaatggaggaagccttgcgcggcctgccaatccgttatcagacacccgcagtaaagagcgagcataccgggagagagattgtcgatctcatgtgccacgctacttttaccacacggctgctttcatccacgagggtgcctaactacaatctgatcgtaatggacgaagcccacttcactgatccgagttctgtggctgcacgcggatacattagcacccgagttgagatgggtgaagccgccgctatctttatgacagcgacacccccaggcgcaactgaccctttcccccaatccaactcaccaatagaggatattgaaagagagatccctgagcggtcttggaatacagggtttgactggatcaccgactatcagggaaaaacggtctggttcgtgcccagcattaaggccggcaacgatatcgctaattgcttgaggaagagtggtaaaaaggtgatacagctatcccgcaaaacttttgacacagaatacccaaagaccaaactgaccgattgggacttcgtcgttactacagatattagcgagatgggggccaactttagagcaggcagggtgatcgacccgcggcgttgtctcaagcctgtaattttaaccgatggacccgaacgcgtgatcctggccggcccaatacccgtcactcctgcttctgcggcccaacgaagagggaggattggacggaacccagcacaggaggacgatcagtatgtgttctcaggtgacccccttaagaatgatgaagaccatgctcactggacagaggccaaaatgctgctcgataacatctacacgcctgagggcatcattccgaccttgttcgggccagaacgcgagaagacacaggcaatcgacggagaatttagactgaggggcgagcaacggaaaactttcgttgagctcatgcgaagaggtgacctgcccgtgtggctttcctataaggtcgccagtgctgggattagctacaaagatcgcgaatggtgctttaccggcgagaggaataaccagatactagaagagaatatggaagtagagatctggacacgggagggagaaaagaagaaactgcgtcctagatggttggacgccagggtgtatgcggatcccatggcattaaaggacttcaaagagtttgcctcgggccgcaagtctattaccctggatatcctcactgaaatcgcttccctgccaacgtaccttagctcacgggccaaactggctctcgacaacattgttatgttgcataccacagagcgagggggcagagcataccagcacgccctgaatgaactacctgagagtctggagactctcatgcttgtggctctgttaggtgccatgaccgcaggcatattcttgtttttcatgcaggggaagggaatcggcaagctgtctatgggtctcattgcgatcgccgtcgcttccgggctgctttgggtggccgaaattcaaccccagtggatcgcagctagcataatcctggagtttttcctcatggtcttgctgattccagaacctgagaaacagaggacaccgcaggataaccaattaatctatgtgattctaaccatcctgactataattggcctcatcgccgcaaatgaaatgggacttattgagaagacaaaaacggactttggcttctaccaggttaagaccgagactacaatcctggatgtggacttgcgccccgcctcagcttggaccctgtatgcggtagccaccacaatactcactccaatgctgcggcacacgatcgaaaacaccagtgcaaatcttagcctcgctgccattgccaaccaggcagctgtgctgatggggttgggaaaaggctggcctctgcatagaatggatttaggtgtccccctactggccatggggtgttactcccaggttaatccaacaactctcaccgcgtctcttgtgatgctgttggtccactatgctatcattggacctggcctgcaagccaaggcaacacgtgaggcccagaaaaggaccgctgcaggtatcatgaagaaccccactgtggacggcataacggtaattgatctcgaaccgatcagctacgacccaaagtttgagaaacagctggggcaagtgatgcttttagttctgtgcgccggacagctcttgctgatgcggacaacctgggcgttctgtgaggtgctaactctggctaccggccctatcctcacactttgggaagggaatcccggacgcttctggaacactaccattgccgtctccacagcaaacatctttcgaggctcatatctggccggtgctgggttggccttctctctgataaagaatgcacagacgccaagaaggggaaccggcactacaggtgagaccctcggcgaaaaatggaagcggcagctgaacagtttagaccgcaaagagtttgaagagtacaagagatcggggattcttgaggtggataggactgaagctaagagcgccctgaaagacggatccaagatcaaacatgcggtctctcgaggctcaagcaagattcggtggatcgtggagcgtgggatggttaaacccaagggaaaggtagtggatctcggctgcggtagagggggatggtcctactatatggccacactcaagaatgtcaccgaagtgaagggctacacgaaaggcgggcctggacacgaggaaccgatacccatggcaacctatggttggaacctggttaagttgcatagtggcgtggacgtcttctacaaaccaacagagcaagtggatactctgctctgtgacatcggggagtctagctcaaatcctaccattgaagagggacgcacacttagggtactgaagatggtggaaccctggttgtccagtaagcctgagttttgcatcaaagttctgaacccatatatgcccactgtcattgaagaactagagaagttacagcggaaacacggcggtaatctggtgagatgtcctcttagccgcaactctacccacgaaatgtactgggtgtccggggcttcaggaaatatcgtcagctcggttaacacaacctctaagatgctgctaaataggttcactacgcgacatcggaaaccaacatatgagaaggatgtggacctcggcgccggcaccagaagtgtatccactgaaaccgagaaacccgatatgacaattatcgggaggcgcctgcagcgtttgcaggaggaacacaaggagacgtggcattacgaccaagaaaacccgtaccggacctgggcatatcacggaagctacgaggctccttcaactggttccgcctctagcatggtgaatggcgtcgtgaagctgctcacaaaaccatgggatgttatacccatggtgacccagcttgccatgactgacacaaccccttttgggcagcagagagtcttcaaggaaaaagtggacacaaggactccacaacccaagccgggaacccgcatggtaatgacgaccacagcgaactggctgtgggctttactgggcaaaaagaagaatcctcgattgtgcactcgggaggagtttattagtaaagttagatccaacgcagccatcggtgctgtgttccaggaagaacaggggtggaccagcgcctctgaagcagtcaatgattcaaggttttgggagctcgtggacaaggaacgcgccctgcaccaagagggaaaatgtgagagttgcgtgtataacatgatgggcaagagagagaaaaagctaggcgagttcgggcgggctaagggatccagggcgatctggtacatgtggcttggtgcccgttttctggagttcgaggcactcggcttcctgaacgaagatcattggtttgggcgagagaatagctggtctggagtcgagggcgaaggtttgcaccgcctggggtatattctcgaggaaatagacaaaaaggatggagaccttatgtacgctgatgacacagccggctgggatactagaatcaccgaggacgatctgcagaacgaggaattaattacggagcagatggcaccccatcacaaaatcctggccaaggctattttcaaattgacatatcagaataaggttgtgaaggtactccggccaacccctaggggcgccgtgatggacatcatatcgcgcaaagatcaaagagggtcaggacaggtcggtacttacggcctgaacacatttaccaatatggaagtgcagctaatccggcagatggaggcggaaggggttattactcaagacgacatgcagaaccccaagggacttaaagagagggtggagaagtggctgcgagaatgcggcgtcgatcgtctcaaaagaatggcaatcagcggtgacgattgtgtggtaaagccactggacgagcgcttcgggacctccttgttatttctgaatgatatgggaaaagttcggaaggacattccccagtgggaacctagtaagggctggaaaaactggcaggaggtgccattctgctctcatcactttcacaagatcttcatgaaagatggcaggagcctcgtcgtgccgtgtagaaatcaagacgaacttatagggcgcgcccggatttcccagggagctggttggtcactgagggagacagcctgcctaggcaaggcatacgctcagatgtggagtctgatgtattttcatcgaagagatctccggttggcctctatggctatctgtagcgccgttcccacggagtggttccctacctccaggactacatggtcaatccacgcacatcaccagtggatgaccactgaagacatgctgaaagtgtggaaccgcgtctggattgaggataatccaaacatgacagacaagacccccgtgcacagctgggaagacataccttaccttgggaagcgtgaggatctgtggtgcggatctctcatcggcttatccagtagagcgacgtgggccaaaaatattcatacagctatcacccaagtacgaaacctgattggtaaggaagagtatgtggactacatgccagtcatgaaaaggtatagcgccttgtcggagtccgaaggggttctgtga

SEQ ID NO: 15722 - RNA, 9867 nt, synthetic construct
  misc_feature 1..9867: note = derived and/or modified CDS sequence (opt3) from DENV-4__EU854299__SS-prME
  source 1..9867: mol_type = other RNA
agcaccataacactgctctgccttattcccactgtgatggccttccacctgtccacgcgggacggcgaacctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactgactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcaggattctgatcggttttcttgtattgtggattgggaccaattcaagaaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaaacttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctagggggccttacttggatggacctgttgcgggccctcattatgctgggcgataccatgtccggcagaatcgggggacagacacatctagctataatggccgttttcaagatgtctccgggttacgtgctgggcgtctttctcaggaaactgaccagccgtgagactgcacttatggtgatcgggatggctatgacaaccacattgtcaattcctcacgacctgatggagttaatcgacggaattagtctcggcctgatccttctgaagatagtaactcagttcgataacacccaagtgggtacgctagccctctccctgacatttattcgctctaccatgagcttggtcatggcatggcggactatcatggccgttctgttcgtggtgaccttaatcccactctgtagaacatcctgcctgcagaaacagtcacattgggtcgaaattactgctcttatcctgggggcgcaagccttgcccgtgtatctcatgaccctgatgaagggagcaagcaggcgaagttggcctctaaatgagggcattatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatataacgggaagttcccctatcattgaagtgaagcaggacgaggatggcagcttttctatccgggacgtcgaggaaacaaacatgattaccttgctcgtgaaactggccctaatcactgtaagcggtctgtacccccttgctataccaatcacaatgaccctctggtatatgtggcaggtcaagactcaacgctccggggcactgtgggatgtgccgagccctgccgcgacacagaaagctgccttgagtgagggagtttacagaattatgcagaggggcttattcggcaagacccaggtgggggtcggaatccacatggaaggtgtgttccacacgatgtggcatgttactcggggcagcgtgatttgtcacgagaccgggcgactggaaccctcttgggcagacgtcagaaatgatatgatctcctatggaggcggttggcgcctcggggacaaatgggataaggaggaggacgtgcaagtactggccatagaaccaggaaagaaccccaaacatgtgcagacaaagcctggcctttttaaaaccctgacaggcgagattggggctgttactttggacttcaagccaggaacctcaggtagtcccatcatcaataggaaaggcaaggtcattgggctatacggaaacggcgtggtgacgaaaagcggtgattatgtctccgccataacacaggcagaacgtatcggggagcctgactacgaggtagatgaagacatttttcggaagaagagactgactatcatggatctccacccgggagctggcaaaaccaagaggattctgccatctatcgtgcgcgaggcccttaaacgaagattacggacactgatactcgcgcccaccagggttgtggccgcagaaatggaggaggctttgcgcggcctgcctatccgttatcagactccagccgtcaagtcggagcataccgggagagagattgtggacctcatgtgccacgctacattcacgactcggctgcttagctcaaccagggttcccaattacaacctgatcgtgatggatgaagcacactttacagacccttccagtgtcgccgcccgcggatacatttctacccgagtggagatgggtgaagctgcggcaatcttcatgactgccacaccgcccggcgctaccgatccatttcctcaaagcaattcccccatagaggacattgaaagagagatcccagagcggtcatggaacacggggttcgattggatcactgactatcagggaaaaacagtatggtttgtgccttctattaaggccggcaatgacatcgcaaactgcttgaggaaatcaggtaaaaaggttatacagctaagtcgcaaaaccttcgataccgaataccccaagactaaactgacagactgggattttgtcgtgaccacagacatttccgagatgggggccaacttcagagctggcagggtgatcgatccacggcgttgtctcaagccggtcattttaactgacggacctgaacgcgttatcctggcgggccccataccagtgacgcccgccagcgcagctcaacgaagagggaggattggacggaatcctgcccaggaggatgaccagtatgtattctctggtgatccacttaagaacgacgaagatcatgcacactggaccgaggccaaaatgctgctcgacaatatctacacacccgagggcatcattcctactttgtttgggccggaacgcgagaagacccaggctatcgatggagagttcagactgaggggcgagcaacggaaaacatttgtggagctcatgcgaagaggtgacctgccagtctggctttcatataaggtggcctccgcggggattagttacaaagaccgcgaatggtgcttcaccggcgagaggaacaatcagatactagaagagaacatggaagttgagatctggactcgggagggagaaaagaagaaactgcgtcccaagtggttggatgcaagagtgtatgccgaccctatggctttaaaagattttaaggagttcgccagcggcaggaaatcgattacgctggacatcctcaccgaaatcgcttctctgcccacatacctttccagccgcgcaaagctggccctcgataatattgtcatgttgcatactaccgagagagggggccgagcttaccagcacgccctgaacgaactaccagagtcactggagacactcatgcttgtagcactgttaggtgcgatgaccgccggcatatttttgttctttatgcaggggaagggaatcggcaaactgagtatgggtctcattactatcgctgtggcctctgggctgctttgggttgcagaaattcaacctcagtggatcgctgcctccataatcctggagttctttctcatggtgttgctgattcccgaaccagagaagcagagaacacctcaggacaatcaattaatctatgtcattctaacgatcctgaccataattggcctcatcgcagccaacgaaatgggacttattgagaaaactaagacagatttcggcttttaccaggtgaaaaccgagaccacaatcctggacgtcgatttgaggccggctagcgcgtggactctgtatgccgtggcaacgaccatactcacacccatgctgcgccacactatcgaaaatacctcagctaaccttagtctcgccgccattgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccatcattggaccaggcctgcaagcaaaagccacgagagaggctcagaagcgtacagcagccggtatcatgaagaatcctaccgttgatggcataactgtgattgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaatcctcacactttgggaagggaaccctggacggttttggaacacgaccattgcagtgagcactgccaatatcttccgcggctcctatctggctggtgccgggttggcattttcactgatcaagaacgctcagacaccccgaagaggaaccggcactacaggtgagaccctcggcgaaaagtggaaaaggcagctaaattctttagaccggaaggagttcgaagagtacaagcgcagtgggattcttgaggttgacagaacggaagccaaatcggcgctgaaggatggaagcaaaatcaagcatgccgtgtccaggggatcttcaaaaattcgatggatcgtcgagcgggggatggtgaagccaaagggaaaagtcgtggacctcggctgcggtcgtgggggatggagctactatatggcaaccctaaagaacgttacagaagtaaaaggctacactaagggcgggcccggacacgaggaacctataccgatggctacctatggttggaatctggtgaaattgcattccggcgtcgatgtgttttacaagcccacagagcaagttgacactctgctctgtgatatcggggagagttctagcaacccaaccattgaagagggaagaacacttcgcgtgctgaagatggtcgaaccttggttgtcatccaaacccgagttctgcatcaaggtgctgaatccttatatgccaaccgtaattgaagaactcgagaaattacagaggaagcacggcggtaacctggtgcggtgtccccttagtagaaatagcactcacgaaatgtactgggtttctggggcctccggaaacatcgtctcaagcgtgaatacgacatcgaaaatgctgctaaaccgctttaccactaggcatcgaaagcctacctatgagaaagacgtggatctcggcgcaggcacacggtctgtcagtacggaaaccgagaagccagacatgactattatcgggagaaggctgcagcgcttgcaggaggaacacaaggagacatggcattacgatcaagaaaatccctaccgtacctgggcttatcacggatcctacgaggccccgagcactggttcagcctcctctatggttaacggcgtggtaaaactgctcacaaagccttgggacgtgataccaatggtcacccagcttgcgatgacagatactacccccttcgggcagcagcgggtgtttaaagaaaaggttgacacgagaacccctcaaccaaaacccggaacaaggatggtgatgactaccacagctaattggctgtgggcattactgggcaagaagaaaaacccgcgcttgtgcactcgagaggagttcattagcaaggtccggagtaatgccgctatcggtgccgtgtttcaggaagaacaggggtggacctccgcaagcgaagccgtaaacgactctagattctgggagctcgttgataaagaaagggctctgcaccaagagggaaagtgtgagtcatgcgtgtataacatgatgggcaaacgcgaaaagaagctaggcgagtttgggagagcgaaaggaagtcgggccatctggtacatgtggcttggtgcaaggttcctggagttcgaggctctcggctttctgaatgaagaccattggttcgggcgtgagaactcctggagcggagtcgagggcgaaggtttgcaccgactggggtatattctcgaggaaatagataagaaagacggagatcttatgtacgccgacgatacggcaggctgggacacacgcatcaccgaggatgacctgcagaatgaggaattaattactgagcagatggcccctcatcacaagatcctggctaaagccatttttaagttgacatatcagaacaaggtggtgaaagtcctcagacccaccccacggggcgcggttatggatatcatatctaggaaggaccaacgcgggtcgggacaggtgggtacttacggcctgaataccttcacaaacatggaagtacagctaatcagacagatggaggcagaaggggtgattacgcaagatgacatgcagaatcctaaaggacttaaggagcgggtcgagaaatggctgagggaatgcggcgtggaccgactcaagcgtatggccatctcaggtgatgactgtgttgtgaaacccctggatgagagatttgggaccagcttgttattcctgaacgacatgggaaaggtccgcaaggatattccacagtgggaaccctccaaaggctggaagaattggcaggaggtgcctttttgcagtcatcacttccacaaaatctttatgaaggacggccggtctctcgtagttccatgtaggaaccaagatgaacttatagggagagctcgcattagccagggagccggttggtccctgcgggagactgcatgcctaggcaaggcttacgcccagatgtggtcactgatgtatttccataggcgagacctcagattggctagtatggccatctgttctgcagtgccgacagagtggtttcccaccagccggactacatggtccatccacgcgcatcaccagtggatgaccacggaagatatgctgaaggtctggaatagggtgtggattgaggacaaccctaatatgatagataagacaccagttcactcatgggaagacatcccctaccttgggaaacgcgaggacctgtggtgcggaagcctcattggcttatcttcccgtgccacctgggctaagaacatccatactgccattacccaagtgagaaatctgatcggtaaagaagagtatgtcgattacatgcctgtgatgaagcgatatagtgcaccaagcgagtcggaaggggtattgtga

SEQ ID NO: 15723 - RNA, 9867 nt, synthetic construct
  misc_feature 1..9867: note = derived and/or modified CDS sequence (opt3) from DENV-4__FJ182016__SS-prME
  source 1..9867: mol_type = other RNA
agcaccataacactgctctgccttattcccactgtgatggccttccacctgtccacgcgggacggcgaacctttgatgatagtcgctaagcatgaaagggggcggccattactgtttaaaaccacagaaggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactgactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcaggattctgatcggttttcttgtattgtggattgggaccaattcaagaaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaaacttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctagggggccttacttggatggacctgttgcgggccctcattatgctgggcgataccatgtccggcagaatcgggggacagacacatctagctataatggccgttttcaagatgtctccgggttacgtgctgggcgtctttctcaggaaactgaccagccgtgagactgcacttatggtgatcgggatggctatgacaaccacattgtcaattcctcacgacctgatggagttaatcgacggaattagtctcggcctgatccttctgaagatagtaactcagttcgataacacccaagtgggtacgctagccctctccctgacatttattcgctctaccatgagcttggtcatggcatggcggactatcatggccgttctgttcgtggtgaccttaatcccactctgtagaacatcctgcctgcagaaacagtcacattgggtcgaaattactgctcttatcctgggggcgcaagccttgcccgtgtatctcatgaccctgatgaagggagcaagcaggcgaagttggcctctaaatgagggcattatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatataacgggaagttcccctatcattgaagtgaagcaggacgaggatggcagcttttctatccgggacgtcgaggaaacaaacatgattaccttgctcgtgaaactggccctaatcactgtaagcggtctgtacccccttgctataccaatcacaatgaccctctggtatatgtggcaggtcaagactcaacgctccggggcactgtgggatgtgccgagccctgccgcgacacagaaagctgccttgagtgagggagtttacagaattatgcagaggggcttattcggcaagacccaggtgggggtcggaatccacatggaaggtgtgttccacacgatgtggcatgttactcggggcagcgtgatttgtcacgagaccgggcgactggaaccctcttgggcagacgtcagaaatgatatgatctcctatggaggcggttggcgcctcggggacaaatgggataaggaggaggacgtgcaagtactggccatagaaccaggaaagaaccccaaacatgtgcagacaaagcctggcctttttaaaaccctgacaggcgagattggggctgttactttggacttcaagccaggaacctcaggtagtcccatcatcaataggaaaggcaaggtcattgggctatacggaaacggcgtggtgacgaaaagcggtgattatgtctccgccataacacaggcagaacgtatcggggagcctgactacgaggtagatgaagacatttttcggaagaagagactgactatcatggatctccacccgggagctggcaaaaccaagaggattctgccatctatcgtgcgcgaggcccttaaacgaagattacggacactgatactcgcgcccaccagggttgtggccgcagaaatggaggaggctttgcgcggcctgcctatccgttatcagactccagccgtcaagtcggagcataccgggagagagattgtggacctcatgtgccacgctacattcacgactcggctgcttagctcaaccagggttcccaattacaacctgatcgtgatggatgaagcacactttacagacccttccagtgtcgccgcccgcggatacatttctacccgagtggagatgggtgaagctgcggcaatcttcatgactgccacaccgcccggcgctaccgatccatttcctcaaagcaattcccccatagaggacattgaaagagagatcccagagcggtcatggaacacggggttcgattggatcactgactatcagggaaaaacagtatggtttgtgccttctattaaggccggcaatgacatcgcaaactgcttgaggaaatcaggtaaaaaggttatacagctaagtcgcaaaaccttcgataccgaataccccaagactaaactgacagactgggattttgtcgtgaccacagacatttccgagatgggggccaacttcagagctggcagggtgatcgatccacggcgttgtctcaagccggtcattttaactgacggacctgaacgcgttatcctggcgggccccataccagtgacgcccgccagcgcagctcaacgaagagggaggattggacggaatcctgcccaggaggatgaccagtatgtattctctggtgatccacttaagaacgacgaagatcatgcacactggaccgaggccaaaatgctgctcgacaatatctacacacccgagggcatcattcctactttgtttgggccggaacgcgagaagacccaggctatcgatggagagttcagactgaggggcgagcaacggaaaacatttgtggagctcatgcgaagaggtgacctgccagtctggctttcatataaggtggcctccgcggggattagttacaaagaccgcgaatggtgcttcaccggcgagaggaacaatcagatactagaagagaacatggaagttgagatctggactcgggagggagaaaagaagaaactgcgtcccaagtggttggatgcaagagtgtatgccgaccctatggctttaaaagattttaaggagttcgccagcggcaggaaatcgattacgctggacatcctcaccgaaatcgcttctctgcccacatacctttccagccgcgcaaagctggccctcgataatattgtcatgttgcatactaccgagagagggggccgagcttaccagcacgccctgaacgaactaccagagtcactggagacactcatgcttgtagcactgttaggtgcgatgaccgccggcatatttttgttctttatgcaggggaagggaatcggcaaactgagtatgggtctcattactatcgctgtggcctctgggctgctttgggttgcagaaattcaacctcagtggatcgctgcctccataatcctggagttctttctcatggtgttgctgattcccgaaccagagaagcagagaacacctcaggacaatcaattaatctatgtcattctaacgatcctgaccataattggcctcatcgcagccaacgaaatgggacttattgagaaaactaagacagatttcggcttttaccaggtgaaaaccgagaccacaatcctggacgtcgatttgaggccggctagcgcgtggactctgtatgccgtggcaacgaccatactcacacccatgctgcgccacactatcgaaaatacctcagctaaccttagtctcgccgccattgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccatcattggaccaggcctgcaagcaaaagccacgagagaggctcagaagcgtacagcagccggtatcatgaagaatcctaccgttgatggcataactgtgattgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaatcctcacactttgggaagggaaccctggacggttttggaacacgaccattgcagtgagcactgccaatatcttccgcggctcctatctggctggtgccgggttggcattttcactgatcaagaacgctcagacaccccgaagaggaaccggcactacaggtgagaccctcggcgaaaagtggaaaaggcagctaaattctttagaccggaaggagttcgaagagtacaagcgcagtgggattcttgaggttgacagaacggaagccaaatcggcgctgaaggatggaagcaaaatcaagcatgccgtgtccaggggatcttcaaaaattcgatggatcgtcgagcgggggatggtgaagccaaagggaaaagtcgtggacctcggctgcggtcgtgggggatggagctactatatggcaaccctaaagaacgttacagaagtaagaggctacactaaaggcgggcccggacacgaggaacctataccgatggctacctatggttggaatctggtgaagttgcattccggcgtcgatgtgttttacaaacccacagagcaagttgacactctgctctgtgatatcggggagagttctagcaacccaaccattgaagagggacgcacacttagggtgctgaagatggtcgaaccttggttgtcatccaagcccgagttctgcatcaaagtgctgaatccttatatgccaaccgtaattgaagaactcgagaagttacagcggaaacacggcggtaacctggtgagatgtccccttagtcgcaatagcactcacgaaatgtactgggtttctggggcctccggaaacatcgtctcaagcgtgaatacgacatcgaagatgctgctaaacaggtttaccactcgacatcggaaacctacctatgagaaggacgtggatctcggcgcaggcacaagatctgtcagtacggaaaccgagaaaccagacatgactattatcgggaggcgcctgcagcgtttgcaggaggaacacaaggagacatggcattacgatcaagaaaatccctaccggacctgggcttatcacggatcctacgaggccccgagcactggttcagcctcctctatggttaacggcgtggtaaagctgctcacaaaaccttgggacgtgataccaatggtcacccagcttgcgatgacagatactacccccttcgggcagcagagagtgtttaaggaaaaagttgacacgaggacccctcaaccaaagcccggaacacgcatggtgatgactaccacagctaattggctgtgggcattactgggcaaaaagaagaacccgcgattgtgcactcgggaggagttcattagcaaagtcagaagtaatgccgctatcggtgccgtgtttcaggaagaacaggggtggacctccgcaagcgaagccgtaaacgactctaggttctgggagctcgttgataaggaacgcgctctgcaccaagagggaaaatgtgagtcatgcgtgtataacatgatgggcaagagagagaaaaagctaggcgagtttgggcgggcgaagggaagtagggccatctggtacatgtggcttggtgcacgtttcctggagttcgaggctctcggctttctgaatgaagaccattggttcgggcgagagaactcctggagcggagtcgagggcgaaggtttgcaccgcctggggtatattctcgaggaaatagataaaaaggacggagatcttatgtacgccgacgatacggcaggctgggacacaagaatcaccgaggatgacctgcagaatgaggaattaattactgagcagatggcccctcatcacaaaatcctggctaaggccatttttaaattgacatatcagaacaaggtggtgaaggtcctccggcccaccccaaggggcgcggttatggatatcatatctcgcaaagaccaaagagggtcgggacaggtgggtacttacggcctgaataccttcacaaacatggaagtacagctaatccggcagatggaggcagaaggggtgattacgcaagatgacatgcagaatcctaagggacttaaagagagggtcgagaagtggctgcgagaatgcggcgtggaccgtctcaaaagaatggccatctcaggtgatgactgtgttgtgaagcccctggatgagcgctttgggaccagcttgttattcctgaacgacatgggaaaagtccggaaggatattccacagtgggaaccctccaagggctggaaaaattggcaggaggtgcctttttgcagtcatcacttccacaggatctttatgaaggacggcagatctctcgtagttccatgtcgcaaccaagatgaacttatagggcgggctaggattagccagggagccggttggtccctgcgagagactgcatgcctaggcaaggcttacgcccagatgtggtcactgatgtatttccatagacgggacctcaggttggctagtatggccatctgttctgcagtgccgacagagtggtttcccaccagccgcactacatggtccatccacgcgcatcaccagtggatgaccacggaagatatgctgaaggtctggaatcgtgtgtggattgaggacaaccctaatatgatagataaaacaccagttcactcatgggaagacatcccctaccttgggaagagagaggacctgtggtgcggaagcctcattggcttatcttcccgagccacctgggctaagaacatccatactgccattacccaagtgaggaatctgatcggtaaagaagagtatgtcgattacatgcctgtgatgaagcggtatagtgcaccaagcgagtcggaaggggtattgtga

SEQ ID NO: 15724 - RNA, 9867 nt, synthetic construct
  misc_feature 1..9867: note = derived and/or modified CDS sequence (opt3) from DENV-4__EU854300__SS-prME
  source 1..9867: mol_type = other RNA
agcaccatcactctgctctgccttattcccactgtgatggccttccacctgtccacgcgggacggcgaacctttgatgatagtcgctaagcatgaaagggggcggccattactgtttaagaccaccgagggaatcaacaagtgtactctgattgcaatggatctcggtgaaatgtgcgaggacaccgttacctacaaatgtccgctgcttgtgaataccgaacccgaggatatcgactgctggtgtaacctgacttctacgtgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcaggattctgatcggttttcttgtattgtggattgggaccaattcaagaaacacaagtatggcaatgacttgcatagccgtcggaggcatcaccctgttcctcggttttacggtgcaggctgacatgggctgtgttgtgtcctggaatgggcgtgagctgaagtgcggaagcggcattttcgtcgtggataacgttcatacatggaccgaacaatacaaatttcagcccgagtctccagcccggcttgcatcagcgatcctgaatgctcacaaggacggggtgtgtggaatccgaagtactacaagattggagaacgtaatgtggaaacagattaccaatgaactcaactatgtcctgtgggagggcggtcacgacttaactgtggtggccggggatgtcaagggagttctgaccaaaggcaagagggcactaacacctcccgccagcgacctcaagtactcctggaaaacgtggggtaaggctaaaatattcaccccagaaactcgcaattctacatttctgatcgatggccccgacacctcggagtgccctaacgaacggagagcctggaatagcttcgaggtggaggattacgggttcggaatgtttacaactaacatttggatgaagttcagggaaggctcctcagaggtatgtgaccatcgccttatgagtgcagctatcaaagatcagaaggccgtgcacgcggacatggggtattggattgaatctagcaaaaatcaaacctggcagatcgagcgagcctccttgatagaagtcaagacgtgcctgtggccaaagacacataccctctggtcaaacggagtgctggagagccagatgttaatcccgaaatcttacgctggccccttttcccagcacaactatcggcaaggttacgcaactcagaccgttgggccttggcacctgggaaaacttgagattgatttcggcgaatgcccaggtacaactgtgaccatccaggagaattgtgaccatcgtggccccagtttgagaacaacgaccgccagcgggaaactcgtcactcagtggtgctgtaggtcttgcacaatgcctccactgcgctttctaggagaagatggctgttggtatgggatggagattcggcccctgtccgagaaggaagagaacatggtgaaatcacaagttaccgctggacagggcacaagtgaaacattcagcatgggtctcctgtgccttaccttgtttgtggaggaatgtctgagaaggcgagtcacgcgcaagcacatgatcttagccgtagtgataactctctgcgcaattatcctagggggccttacctggatggacctgttgcgggcgctcattatgctgggcgatacaatgtcgggcagaatcgggggacagacccatctagccataatggctgttttcaagatgtccccgggttacgtgctgggcgtctttctcaggaaactgacttctcgtgagacagcccttatggtgatcgggatggcaatgaccacaactttgagcattcctcacgacctgatggagttaatcgacggaatttcactcggcctgatccttctgaagatagtaacccagttcgataatacgcaagtgggtacactagctctcagtctgacctttattcgctccactatgtctttggtcatggcctggcggaccatcatggcagttctgttcgtggtgacattaatcccactctgtagaactagctgcctgcagaaacagtcccattgggtcgaaattaccgcccttatcctgggggctcaagcgttgcccgtgtatctcatgacgctgatgaagggagcctcaaggcgaagctggcctctaaacgagggcattatggcagttggcctggtaagtcttctcgggtctgctctgttgaaaaatgacgtgcccctggccggaccaatggtcgccggtggcttactcctggctgcatacgtgatgtccgggagctcggccgatctttcactggaaaaggcggctaacgttcagtgggacgagatggccgatataacaggatctagtcctatcattgaagtgaagcaggacgaggatggctcctttagcatccgggacgtcgaggaaaccaatatgattactttgctcgtgaaactggcactaatcacagtatctggtctgtacccccttgccataccaatcaccatgactctctggtatatgtggcaggtcaagacacaacgcagcggggctctgtgggatgtgccgtcccctgcagccacccagaaagcggctttgtcagagggagtttacagaattatgcagaggggcttattcggcaagacacaggtgggggtcggaatccacattgaaggtgtgttccacactatgtggcatgttacccggggcagtgtgatctgtcacgagacagggcgactggaacccagctgggccgacgtcagaaacgatatgatatcttatggaggcggttggcgcctcggggacaaatgggataaggaggaggacgtgcaagtactggcaattgaaccaggaaagaatcccaaacatgtgcagaccaagcctggcctttttaaaacactgactggcgagatcggggccgttaccttggacttcaagccaggaacgtccggttcacccatcattaacaggaaaggcaaggtcatagggctatacggaaatggcgtggtgacaaaaagtggtgattatgtcagcgctatcactcaggccgaacgtattggggagcctgactacgaggtagatgaagacatctttcggaagaagagactgaccattatggatctccacccgggagcaggcaaaacaaagaggatcctgccatccatagtgcgcgaggctcttaaacgaagattacggaccctgatcctcgcccccactagggttgtggcggccgaaatggaggaagcattgcgcggcctgcctattcgttatcagaccccagctgtcaagtctgagcatacagggagagagatcgtggacctcatgtgccacgccacgttcactacccggctgctttcgagcacaagggttcccaactacaatctgattgtgatggatgaagctcactttaccgacccttcatccgtcgcagcccgcggatacatcagtactcgagtggagatgggtgaagccgctgcgatattcatgacagcaaccccgcccggcgccacggatccatttcctcaatctaacagccccattgaggacatcgaaagagagatcccagagcggtcctggaatactgggttcgattggattacagactatcagggaaaaaccgtatggtttgtgccttcaatcaaggctggcaacgacatagccaactgcttgaggaagtctggtaaaaaggttattcagctaagccgcaaaaccttcgatactgaataccccaagacaaaactgaccgactgggattttgtcgtgacaactgacatcagtgagatgggggcaaatttcagagccggcagggtgattgatccacggcgttgtctcaagccggtcatcttaacggacggacctgaacgcgttatactggctggccccattccagtgacccccgcgtccgccgcacaacgaagagggaggatcggacggaaccttgctcaggaggatgaccagtatgtattcagcggtgatcctctgaagaatgacgaagatcatgcccactggacagaggcaaaaatgctcttggacaacatctacactccagagggcattatccccaccctgtttgggcctgaacgcgagaagacacaggccattgatggagagttcagactcaggggcgagcaacggaaaacctttgtggagctgatgcgaagaggtgaccttccggtctggctatcttataaggtggcttcagccgggatatcctacaaagaccgcgaatggtgcttcactggcgagaggaataaccagatcctggaagagaatatggaagttgagatttggacgcgggagggagaaaagaagaaattgcgtccaaagtggttagatgcgagagtgtatgcagaccccatggccctgaaagattttaaggagttcgctagtggcaggaaaagcatcaccctcgacatcctgacagaaattgcctcgcttcctacttacctgtcttcccgcgctaagctcgcattggataacatagtcatgctgcataccacagagagagggggacgagcctaccagcacgctctaaatgaactgcccgagagcctcgagacccttatgctggtagccttattgggtgcaatgactgcgggcatctttctgttctttatgcaggggaagggaattggcaaactctcaatgggtctgatcacaattgccgtggctagtgggcttctgtgggttgccgaaatccaaccacagtggatagcagcttctatcattctcgagttctttttgatggtgctgttaatccctgaacccgagaagcagagaacgccacaggacaaccaactaatttatgtcatcctgaccatactcactattatcggccttattgccgcaaatgaaatgggactgatcgagaaaacaaaggccgatttcggcttttaccaggtgaaaaccgagaccacaatattggacgtcgatctgaggcctgcttccgcgtggactctctatgccgtggcaacgaccatcctgacaccgatgcttcgccacactattgaaaacaccagcgctaatctctcactggccgccatcgcaaaccaggctgccgttttgatggggctgggaaagggctggcccttacatcggatggacctaggtgtgccactgctcgcgatggggtgttacagtcaggtaaatcctacaacccttactgctagcctggtgatgttgctggtccactatgccattatcggacccggcctccaagcaaaagccacgagagaggctcagaagcgtacagcagccggtataatgaagaacccaaccgttgatggcattactgtgatcgacctggaacctatctcctacgatcccaaattcgagaagcagcttgggcaagtcatgttactggtgctctgcgcgggacagttgctgctaatgaggaccacatgggctttctgtgaggtactgactctcgccaccggcccgattcttacactgtgggaagggaacccaggacggttttggaatacgaccatcgcagtgtctactgccaacatattccgcggcagctatttggctggtgccgggctggcattttccctcattaaaaatgctcagacacctcgaagaggaaccggcactacaggtgagaccctgggcgaaaagtggaaaaggcagttaaactcacttgaccggaaggagttcgaagagtacaagcgctctgggatcctggaggttgacagaacggaagccaaaagtgcgctcaaggatggatcgaaaattaagcatgccgtgagcaggggctcctctaaaatccgatggatagtcgagcgggggatggtgaagcccaagggaaaagtcgtggacctaggctgcggtcgtgggggatggtcatactatatggcaaccctgaagaatgttacagaagtaaaaggctacactaagggcgggccaggacacgaggaacccatccctatggctacctatggttggaacttggtgaaactgcatagcggcgtcgatgtgttttacaagccgacagagcaagttgacactctcctttgtgatattggggagtccagttctaatcccaccatcgaagagggaagaacactgcgcgtgttgaagatggtcgaaccatggctgagctcaaaacctgagttctgcattaaggtgctcaacccctatatgcctaccgtaatcgaagagttagagaaactgcagaggaagcacggcggtaatcttgtgcggtgtccactgtccagaaacagtactcacgaaatgtactgggttagcggggcctctggaaatattgtctcctcagtgaacacgacaagcaaaatgctactcaatcgctttaccactaggcatcgaaagcccacctatgagaaagacgtggatctgggcgcaggcacacggtcggtctctacggaaaccgagaagcctgacatgactatcatagggagaaggttgcagcgcctgcaggaggaacacaaggagacatggcattacgatcaagaaaacccataccgtacctgggcttatcacggaagttacgaggccccctccactggtagcgcctcatccatggttaatggcgtggtaaaactccttacaaagccgtgggacgtgattcctatggtcacccagctggcgatgacagatactaccccattcgggcagcagcgggtgtttaaagaaaaggttgacacgagaacaccccaacctaaaccaggaacaaggatggtgatgactaccacagctaactggttatgggcactgttgggcaagaagaaaaatccccgcctctgcactcgagaggagttcatctctaaggtccggagcaacgccgctatcggtgccgtgtttcaggaagaacaggggtggaccagtgcatccgaagccgtaaacgacagcagattctgggagctggttgataaagaaagggctctacaccaagagggaaagtgtgagtcttgcgtgtataatatgatgggcaaacgcgaaaagaaacttggcgagtttgggagagcgaaaggatcacgggccatttggtacatgtggctgggtgcaaggttcctcgagttcgaggctctgggctttttgaacgaagaccattggttcgggcgtgagaatagttggtccggagtcgagggcgaaggtctgcaccgactcgggtatatacttgaggaaatcgataagaaagacggagatctgatgtacgccgacgatacggcaggctgggacacacgcattaccgaggatgacttacagaacgaggaactgatcactgagcagatggccccgcatcacaagattttggctaaagccatctttaagctcacatatcagaataaggtggtgaaagtcctgagacctacaccccggggcgcggttatggatataatcagcaggaaggaccaacgcgggtctggacaggtgggtacttacggcctaaacaccttcacaaatatggaagtacagcttattagacagatggaggcagaaggggtgatcacgcaagatgacatgcagaacccaaaaggactgaaggagcgggtcgagaaatggctcagggaatgcggcgtggaccgactgaagcgtatggccatttcgggtgatgactgtgttgtgaaacctttggatgagagatttgggacctcattactgttcctcaatgacatgggaaaggtccgcaaggatatcccccagtgggaaccaagcaaaggctggaagaactggcaggaggtgcccttttgctcccatcacttccacaaaatatttatgaaggacggccggagtcttgtagttccttgtaggaatcaagatgaactgattgggagagctcgcatctctcagggagccggttggagcctacgggagactgcatgcctgggcaaggcttacgcccagatgtggtccctcatgtatttccataggcgagacttgagactggcttcaatggccatctgtagtgcagtgccaacagagtggtttccgacctctcggactacatggagcattcacgcgcatcaccagtggatgaccacggaagatatgcttaaggtctggaacagggtgtggatagaggacaatcccaacatgatcgataagacacctgttcactcctgggaagacattccatacctggggaaacgcgaggacctctggtgcggatcattaatcggcctgagctctcgtgccacctgggctaagaatattcatactgccatcacccaagtgagaaacttgataggtaaagaagagtatgtcgattacatgcccgtgatgaagcgatattccgcacctagtgagagcgaaggggtactgtga

SEQ ID NO: 15725 - RNA, 9867 nt, synthetic construct
  misc_feature 1..9867: note = derived and/or modified CDS sequence (opt3) from DENV-4__FJ182017__SS-prME
  source 1..9867: mol_type = other RNA
agcaccataacactgctctgccttattcccactgtgatggcattccacctgtccacgcgggacggcgagcctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctgcatgggtaatgtatggcacatgcacccagtcaggggagcgccgacgtgaaaagagaagtgtggcgttgacgcctcacagcggaatgggcctcgagactagggctgaaacctggatgtcctctgagggtgcctggaaacatgcacaacgggtcgagtcgtggattctgcgcaatccagggttcgccctgctcgctggatttatggcatacatgatcggccagacaggcatacagagaactgtgttctttgttttaatgatgctggtggccccctcatatgggatgaggtgtgtcggagtgggtaaccgggatttcgtagaaggcgttagcgggggagcttgggtggaccttgtcttggagcacggcggttgcgtgaccacaatggcccaggggaagcctaccctggattttgaactgacgaagactacagcgaaagaggtggcactcctgcgcacctactgtatcgaagcccttattagtaatatcactacagctacccgatgcccaacgcaaggagagccctatctgaaggaggaacaggaccagcagtacatttgtagaagggatgtcgttgaccggggctggggcaacgggtgcggattgttcggtaaaggcggggtggtaacctgcgccaagttttcctgttctggaaaaatcacaggcaatctcgtgcaaatagagaacctggaatatactgtcgtggttaccgtgcataatggtgatacacacgcagtcgggaacgacactagcaatcacggcgtgaccgctacaattacccctcgttccccatcagtagaggttaagttaccggattacggagaactgactctcgactgcgagccccgcagtggcatcgacttcaacgagatgattcttatgaagatgaaaaagaaaacgtggctggtgcataagcagtggtttttggatctacctctgccatggacaaccggggccgacactagcgaagtccactggaattacaaagagagaatggtgaccttcaaggtcccccatgcgaaaaggcaggatgtgacagttctcggatctcaggaaggtgccatgcactccgcactggctggcgccaccgaggtggactcaggggatggaaaccacatgtttgctggccatcttaagtgtaaggtacggatggaaaaactgcgaatcaagggtatgagctatactatgtgcagtgggaaattctctatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatctccgctactcccttggcggagaacacaaacagcgttaccaatattgagctcgaaccgcctttcggagactcgtatatcgtcataggtgtgggcaactctgcactgacattacattggtttaggaaagggtcctcaattggaaagatgttcgagagtacttaccggggcgccaaacgcatggctatcctgggtgaaaccgcctgggattttgggagcgtgggcggactattcacgtccctcggcaaggcagtccaccaggtttttgggtctgtgtataccacaatgttcggaggcgtgagctggatgatcaggattctgatcggttttcttgtattgtggattgggactaattcaagaaacaccagtatggccatgacatgcatagctgtcggaggcatcactctgttcctcggttttaccgtgcaggccgacatgggctgtgttgtgtcctggagcgggcgtgagctgaagtgcggatctggcattttcgtcgtggataatgttcatacgtggacagaacaatacaaatttcagcccgagtcaccagcacggcttgcgagtgctatcctgaacgcccacaaggacggggtgtgtggaatccgaagcaccactagattggagaatgtaatgtggaaacagattacaaacgaactcaattatgtcctgtgggagggcggtcacgacttaaccgtggtggcaggggatgtcaagggagttctgactaaaggcaagagggccctaacccctcccgcttccgacctcaagtactcttggaaaacatggggtaaggccaaaatattcacgccagaagcacgcaactcgacctttctgatcgatggccccgacactagcgagtgccctaatgaacggagagcttggaactccttcgaggtggaggattacgggttcggaatgtttacaaccaatatttggatgaagttcagggaaggctcaagtgaggtatgtgaccatcgccttatgtctgccgcgatcaaagatcagaaggccgtgcacgctgacatggggtattggattgaaagctccaaaaaccaaacatggcagatcgagcgagcatcattgatagaagtcaagacttgcctgtggccaaagacccatacgctctggagcaatggagtgctggagtctcagatgttaatcccgaaatcctacgccggcccctttagtcagcacaactatcggcaaggttacgctacacagaccgttgggccttggcacctgggaaaacttgagattgatttcggcgaatgcccaggtactaccgtgacaatccaggagaactgtgaccatcgtggccccagcttgagaactaccacagcctctgggaaactcgtcacgcagtggtgctgtaggtcctgcaccatgcctccactgcgctttctaggagaagatggctgttggtatgggatggagattcggcccctgtcagagaaggaagagaatatggtgaaaagtcaagttactgcaggacagggcacaagcgaaaccttctcgatgggtctcctgtgccttactttgtttgtggaggaatgtctgagaaggcgagtcacacgcaagcacatgatcttagcggtagtgataaccctctgcgccattatcctagggggccttacgtggatggacctgttgcgggctctcattatgctgggcgatactatgtccggcagaatcgggggacagacccatctagccataatggcagttttcaagatgtctccgggttacgtgctgggcgtctttctcaggaaactgacaagccgtgagaccgctcttatggtgatcgggatggccatgactacaaccttgtcaattcctcacgacctgatggagttaatcgacggaattagtctcggcctgatccttctgaagatagtaacacagttcgataacactcaagtgggtaccctagcactctccctgacgtttattcgctctacaatgagcttggtcatggcctggcggaccatcatggctgttctgttcgtggtgactttaatcccactctgtagaacctcctgcctgcagaaacagtcacattgggtcgaaattacagcgcttatcctgggggcccaagcattgcccgtgtatctcatgactctgatgaagggagctagcaggcgaagttggcctctaaatgagggcattatggccgttggcctggtatctcttctcgggtccgccctgttgaaaaacgacgtgcccctggctggaccaatggtcgccggtggcttactcctggccgcgtacgtgatgagcgggtcgtcagctgatctttctctggaaaaggccgcaaatgttcagtgggacgagatggccgatataaccggaagttcccctatcattgaagtgaagcaggacgaggatggcagcttttctatccgggacgtcgaggaaacgaacatgattacattgctcgtgaaactggctctaatcaccgtaagcggtctgtacccccttgcaataccaatcactatgacactctggtatatgtggcaggtcaagacccaacgctccggggccctgtgggatgtgccgagccctgcggctactcagaaagccgcattgagtgagggagtttacagaattatgcagaggggcttattcggcaagacacaggtgggggtcggaatccacatggaaggtgtgttccacaccatgtggcatgttacgcggggcagcgtgatttgtcacgagactgggcgactggaaccctcttgggccgacgtcagaaatgatatgatctcctatggaggcggttggcgcctcggggacaaatgggataaggaggaggacgtgcaagtactggctatagaaccaggaaagaaccccaaacatgtgcagaccaagcctggcctttttaaaacactgaccggcgagattggggccgttacattggacttcaagccaggaacttcaggtagtcccatcatcaataggaaaggcaaggtcattgggctatacggaaacggcgtggtgaccaaaagcggtgattatgtctccgcaataacgcaggctgaacgtatcggggagcctgactacgaggtagatgaagacatttttcggaagaagagactgacaatcatggatctccacccgggagccggcaaaactaagaggattctgccatctatcgtgcgcgaggcgcttaaacgaagattacggaccctgatactcgcccccacaagggttgtggcagctgaaatggaggaagccttgcgcggcctgcctatccgttatcagaccccagctgtcaagtcggagcatactgggagagagattgtggacctcatgtgccacgcaaccttcacaacgcggctgcttagctcaactagggttcccaattacaacctgatcgtgatggatgaagcccactttaccgacccttccagtgtcgccgctcgcggatacatttctacacgagtggagatgggtgaagcggcagccatcttcatgaccgctactccgcccggcgccacagatccatttcctcaaagcaattcccccatagaggacattgaaagagagatcccagagcggtcatggaacaccgggttcgattggatcacggactatcagggaaaaactgtatggtttgtgccttctattaaggcaggcaatgacatcgccaactgcttgaggaaatcaggtaaaaaggttatacagctaagtcgcaaaacattcgataccgaataccccaagaccaaactgactgactgggattttgtcgtgacaaccgacatttccgagatgggggctaacttcagagcgggcagggtgatcgatccacggcgttgtctcaagccggtcattttaacagacggacctgaacgcgttatcctggccggccccataccagtgactcccgcaagcgctgcccaacgaagagggaggattggacggaatcctgcacaggaggatgaccagtatgtattctctggtgatccacttaagaacgacgaagatcatgcccactggacggaggctaaaatgctgctcgacaatatctacacccccgagggcatcattcctacattgtttgggccggaacgcgagaagactcaggccatcgatggagagttcagactgaggggcgagcaacggaaaacctttgtggagctcatgcgaagaggtgacctgccagtctggctttcatataaggtggcgtccgcagggattagttacaaagaccgcgaatggtgcttcacaggcgagaggaacaatcagatactagaagagaacatggaagttgagatctggacccgggagggagaaaagaagaaactgcgtcccaagtggttggatgccagagtgtatgctgaccctatggccttaaaagattttaaggagttcgctagcggcaggaaatcgattactctggacatcctcacggaaatcgcatctctgcccacctacctttccagccgcgccaagctggctctcgataatattgtcatgttgcatacaactgagagagggggacgagcctaccagcacgcactgaacgaactaccagagtcactggagaccctcatgcttgtagcgctgttaggtgccatgacagctggcatatttttgttctttatgcaggggaagggaatcggcaaactgagtatgggtctcattaccatcgccgtggcatctgggctgctttgggttgctgaaattcaacctcagtggatcgccgcatccataatcctggagttctttctcatggtgttgctgattcccgaaccagagaagcagagaactcctcaggacaatcaattaatctatgtcattctaacaatcctgacgataattggcctcatcgccgctaacgaaatgggacttattgagaaaaccaagactgatttcggcttttaccaggtgaaaacagagaccaccatcctggacgtcgatttgaggccggcgagcgcctggacactgtatgcagtggctactacgatactcacccccatgctgcgccacacaatcgaaaatacttcagccaaccttagtctcgccgcaattgctaatcaggccgcggttctgatggggttgggaaagggctggccactgcatcggatggacttaggtgtgcctctactggctatggggtgttacagccaggtaaaccccaccacactcaccgcctcccttgtgatgctgttggtccactatgcaatcattggaccaggcctgcaagccaaagctactagagaggcacagaagcgtacggccgcgggtatcatgaagaatcctacagttgatggcataaccgtgattgacctcgaacccatctcttacgatccgaaattcgagaagcagctggggcaagtcatgcttttagctctgtgcgccggacagctcttgctgatgaggactacctgggcattctgtgaggtgctaacactggccactggcccaatcctcaccctttgggaagggaaccctggacggttttggaacacaacgattgctgtaagcaccgccaatatcttccgcggctcctatctggccggtgctgggttggccttttcactgatcaagaacgcgcagactccccgaagaggaacaggcaccactggtgagacactcggcgaaaagtggaaaaggcagctaaattctttagaccggaaggagttcgaagagtacaagcgcagtgggattcttgaggtggacagaaccgaagccaaatcggcactgaaggatggaagcaaaatcaagcatgctgtttccaggggatcttcaaaaattcgatggatcgtggagcgggggatggtcaagccaaagggaaaagtggtcgacctcggctgcggtcgtgggggatggagctactatatggccacgctaaagaacgtgaccgaagttaaaggctacacaaagggcgggcccggacacgaggaacctataccgatggcaacttatggttggaatctggtaaaattgcattccggcgtggatgtcttttacaagcccaccgagcaagtggacacactgctctgtgatatcggggagagttctagcaacccaactattgaagagggaagaacccttcgcgttctgaagatggtggaaccttggttgtcatccaaacccgagttctgcatcaaggtcctgaatccttatatgccaacagtgattgaagaactcgagaaattacagaggaagcacggcggtaacctggtacggtgtccccttagtagaaatagcacccacgaaatgtactgggtgtctggggcttccggaaacatcgtttcaagcgtcaatactacgtcgaaaatgctgctaaaccgctttacaaccaggcatcgaaagcctacttatgagaaagacgtggatctcggcgccggcacccggtctgtgagtacagaaacggagaagccagacatgaccattatcgggagaaggctgcagcgcttgcaggaggaacacaaggagacttggcattacgatcaagaaaatccctaccgtacatgggcctatcacggatcctacgaggcgccgagcaccggttcagcttcctctatggtcaacggcgttgtgaaactgctcactaagccttgggacgtaataccaatggtgacacagcttgcaatgaccgatacaactcccttcgggcagcagcgggtctttaaagaaaaggtggacaccagaacgcctcaaccaaaacccggaaccaggatggttatgacaactaccgccaattggctgtgggctttactgggcaagaagaaaaacccgcgcttgtgcacacgagaggagttcattagcaaggtgcggagtaatgccgcaatcggtgccgtctttcaggaagaacaggggtggacttccgctagcgaagcggtgaacgactctagattctgggagctcgtagataaagaaagggccctgcaccaagagggaaagtgtgagtcatgcgtttataacatgatgggcaaacgcgaaaagaagctaggcgagtttgggagagcaaaaggaagtcgggctatctggtacatgtggcttggtgccaggttcctggagttcgaggcactcggctttctgaatgaagaccattggttcgggcgtgagaactcctggagcggagtggagggcgaaggtttgcaccgactggggtatattctcgaggaaatagataagaaagacggagatcttatgtacgccgacgataccgctggctgggacacgcgcatcacagaggatgacctgcagaatgaggaattaattaccgagcagatggcccctcatcacaagatcctggcgaaagcaatttttaagttgacttatcagaacaaggtcgtgaaagtgctcagacccacaccacggggcgccgtcatggatatcatatctaggaaggaccaacgcgggtcgggacaggttggtacctacggcctgaatactttcaccaacatggaagtgcagctaatcagacagatggaggctgaaggggtaattacacaagatgacatgcagaatcctaaaggacttaaggagcgggtggagaaatggctgagggaatgcggcgtcgaccgactcaagcgtatggccatctcaggtgatgactgtgtggttaaacccctggatgagagatttgggacgagcttgttattcctgaacgacatgggaaaggtgcgcaaggatattccacagtgggaaccctccaaaggctggaagaattggcaggaggtccctttttgcagtcatcacttccacaaaatctttatgaaggacggccggtctctcgtggtaccatgtaggaaccaagatgaacttatagggagagcacgcattagccagggagctggttggtccctgcgggagaccgcctgcctaggcaaggcttacgcccagatgtggtcactgatgtatttccataggcgagacctcagattggcaagtatggcgatctgttctgccgttccgactgagtggtttcccacaagccggaccacttggtccatccacgctcatcaccagtggatgacaaccgaagatatgctgaaggtgtggaatagggtctggattgaggacaaccctaatatgatagataagacgccagtgcactcatgggaagacatcccctaccttgggaaacgcgaggacctgtggtgcggaagcctcattggcttatcttcccgtgccacatgggcaaagaacatccataccgctattactcaagttagaaatctgatcggtaaagaagagtatgtggattacatgcctgtcatgaagcgatatagtgccccaagcgagtcggaaggggtgttgtga

SEQ ID NO: 15726 - RNA, 9867 nt, synthetic construct
  misc_feature 1..9867: note = derived and/or modified CDS sequence (opt3) from DENV-4__EU854301__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccactggggctgacacctctgaagtccactggaattacaaagagagaatggtgacattcaaggtcccccatgccaaaaggcaggatgtgaccgttctgggatcccaggaaggtgcgatgcactcagccctcgcaggcgctactgaggtggacagcggggatggaaaccacatgtttgccggccatctgaagtgtaaggtacggatggaaaaacttcgaatcaagggtatgagttatacaatgtgctctgggaaattctccatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatcagcgccacacccctggctgagaacaccaactcggttacaaatattgagttggaaccgcctttcggagactcttatatcgtcataggtgtgggcaactccgcgctcactctgcattggtttaggaaagggtcaagtattggaaagatgttcgagagcacctaccggggcgcaaaacgcatggccatcttaggtgaaacggcttgggattttgggtccgtgggcggactgttcacctctctaggcaaggccgtccaccagatctttgggagcgtttatacaactatgttcggaggcgtgtcatggatgattagaatcctcattggttttctggtgctttggatagggaccaatagtaggaacacatccatggcaatgacttgcatcgccgtaggaggcattaccttgttcctgggttttacggtccaggctgacatgggctgtgtggttagctggtctgggcgtgagctcaagtgcggatcaggcatcttcgtggtcgataatgtgcatacatggaccgaacaatacaaatttcagcccgagagtccagcccggctggcaagcgcgatccttaacgctcacaaggacggggtttgtggaattcgatccactacaagactggagaatgtgatgtggaaacagataaccaacgaattgaattatgtactctgggagggcggtcacgacctgactgtcgtggccggggatgtgaagggagtcttaaccaaaggcaagagggcactgacacctcccgcctctgacctaaagtactcgtggaaaacgtggggtaaggctaaaatcttcaccccagaagcccgcaacagcacttttctcattgatggccccgacacatccgagtgccctaatgaacggagagcatggaactcattcgaggttgaggattacgggttcggaatgtttaccacaaatatctggatgaagttcagggaaggcagttctgaggtgtgtgaccatcgcctgatgagcgctgccattaaagatcagaaggcggtacacgccgacatggggtattggatcgaatcctcaaaaaaccaaacttggcagatagagcgagctagccttatcgaagtgaagacctgcttgtggccaaagacgcatacactgtggtctaatggagtcctcgagtcccagatgctgattccgaaaagttacgcaggcccctttagccagcacaactatcggcaaggttacgccacccagactgtggggccttggcacttaggaaagctggagatcgatttcggcgaatgcccaggtaccacagttactattcaggagaactgtgaccatcgtggcccctctcttagaaccacaacggcttccgggaaattggtgacccagtggtgctgtaggtcatgcactatgcctccactccgctttctgggagaagatggctgttggtatgggatggagatccggcccctaagtgagaaggaagagaatatggtcaaaagccaagtgacagccggacagggcacctcggaaactttctccatgggtctgctctgcctgacactttttgttgaggaatgtttgagaaggcgagtgacccgcaagcacatgatactggcagtcgtaattacgttatgcgcgatcattctcgggggactgacttggatggaccttctgcgggccttgatcatgctcggcgataccatgtctggcagaatagggggacagacacatctggctatcatggccgtgttcaagatgagcccgggttacgttctaggcgtgtttctgaggaaactcacctcacgtgagactgcactgatggtcattgggatggctatgacaaccacacttagtatccctcacgacttgatggagctgattgacggaatctccttaggcctcatactgcttaagattgtgactcagttcgataacacccaagtaggtacgctggccctatctctcacatttatccgcagcaccatgtccctggtgatggcatggcggactatcatggccgtcttgttcgttgtgaccctgattccattatgtagaacatcatgcctccagaaacagagccattgggtggaaatcactgctctgattcttggggcgcaagccctgcccgtctatttgatgaccctcatgaagggagcaagtaggcgatcttggcctctgaatgagggcataatggctgtgggcctagtttccctgcttgggagcgccctcctgaaaaacgacgtacccttggccggaccaatggtggctggtggcctgttactcgcagcctacgtcatgtcggggtcatctgcggatctgagtcttgaaaaggctgccaatgtgcagtgggacgagatggcagatatcacgggatccagccctattatcgaagttaagcaggacgaggatggctcttttagcattcgggacgtggaggaaacaaacatgatcaccctgttggtcaaactcgccctgataactgtgtccggtctataccccctggctatcccaattacaatgaccctttggtatatgtggcaggtaaagactcaacgctcaggggcactctgggatgtcccgagtcctgccgcgacacagaaagctgccctgagcgagggagtgtacagaatcatgcagaggggcttgttcggcaagacccaggttggggtgggaattcacatggaaggtgtcttccacacgatgtggcatgtgactcggggctctgttatctgtcacgagaccgggcgattagaaccctcctgggcagacgtgagaaatgatatgatatcatatggaggcggttggcgcctgggggacaaatgggataaggaggaggacgtccaagtgctcgccattgaaccaggaaagaaccccaaacatgtacagacaaagcctggcctgtttaaaacccttacaggcgagatcggggctgtgactctggacttcaagccaggaaccagtggtagccccatcattaataggaaaggcaaggttatagggttgtacggaaacggcgtcgtgacgaaatccggtgattatgtgtctgccatcacacaggcagaacgtattggggagcctgactacgaggtcgatgaagacatctttcggaagaagagactaactattatggatctgcacccgggagctggcaaaaccaagaggatcctcccatcgatagtacgcgaggccctgaaacgaagacttcggacattaatcctggcgcccaccagggtggttgccgcagaaatggaggaagctctccgcggcttgcctattcgttatcagactccagccgtgaagagcgagcataccgggagagagatcgtcgacctgatgtgccacgctacattcacgactcggctcctgtcatccaccagggtgcccaattacaaccttattgttatggatgaagcacactttacagaccctagttctgtggccgcccgcggatacatcagcacccgagtcgagatgggtgaagctgcggcaatattcatgactgccacaccgcccggcgctaccgatccatttcctcaatccaattcacccattgaggacatcgaaagagagatcccagagcggtcttggaacacggggttcgattggattactgactatcagggaaaaacagtgtggtttgtacctagcatcaaggccggcaatgacatagcaaactgcctgaggaagagtggtaaaaaggtgattcagttgtcccgcaaaaccttcgataccgaataccccaagactaaactaacagactgggattttgttgtcaccacagacatcagcgagatgggggccaacttcagagctggcagggtgattgatccacggcgttgtctgaagccggtgatcctcactgacggacctgaacgcgtcatattagcgggccccattccagttacgcccgcctctgcagctcaacgaagagggaggatcggacggaatcctgcccaggaggatgaccagtatgtgttctcaggtgatccactgaagaacgacgaagatcatgcacactggaccgaggccaaaatgcttctggacaatatctacacacccgagggcattatccctactctctttgggccggaacgcgagaagacccaggctattgatggagaattcagattgaggggcgagcaacggaaaacatttgtagagctgatgcgaagaggtgacctcccagtgtggctgtcctataaggtcgccagtgcggggataagctacaaagaccgcgaatggtgcttcaccggcgagaggaacaatcagatccttgaagagaacatggaagtggagatttggactcgggagggagaaaagaagaaactacgtcccaagtggctggatgcaagagtttatgccgaccctatggctttgaaagattttaaggagttcgcctcgggcaggaaatctatcacgttagacatcctgaccgaaattgcttccctccccacatacctgagctcacgcgcaaagcttgccctggataatatagtgatgctccatactaccgagcgggggggacgagcttaccagcacgccttgaacgaactgccagagagtctagagacactgatgctcgtcgcacttctgggtgcgatgaccgccggcatctttttattctttatgcaggggaagggaatgggcaaattgtctatgggtctgattactatcgctgtagcctccgggctcctgtgggtggcagaaattcaacctcagtggatcgctgccagcataatccttgagttctttctgatggttctcttgattcccgaaccagagaagcagagaacacctcaggacaatcaactgatctatgtgattttaacgatcctaaccataattggcctgatcgcagccaacgaaatgggactcattgagaaaactaagacagatttcggcttttaccaggtcaaaaccgagaccacaatccttgacgtggatctgaggccggcttcagcgtggactttgtatgccgtcgcaacgaccatactgacacccatgctccgccacactatcgaaaataccagtgctaacctgagccttgccgccattgcaaatcaggctgccgtgctcatggggctgggaaagggctggccattgcatcggatggacctgggtgttcctttactagcgatggggtgttactcccaggtgaaccccacaaccctgactgcttctctcgtaatgcttctggtgcactatgccatcattggaccaggcttgcaagcaaaagccacgagagaggctcagaagcgtacagcagccggtatcatgaagaatcctaccgtcgatggcataactgttattgacctggaacccatcagctacgatccgaaattcgagaagcagctcgggcaagtgatgctgcttgtcttatgcgcgggacagctgttcctcatgaggaccacatgggctttttgtgaggtgttgactctggccaccggcccaatcctaacactgtgggaagggaaccctggacggttctggaacacgaccattgcagtatccactgccaatatctttcgcggctcatatctcgctggtgccgggcttgcattctctctgataaaaaacgctcagacaccccgaagaggaaccggcactacaggtgagaccttgggcgaaaagtggaaaaggcagctgaatagtctcgaccggaaggagtttgaagagtacaagcgctcggggattctggaggtggacagaacggaagccaaaagcgcgttaaaggatggatccaaaatcaagcatgccgtttctaggggctcaagcaaaattcgatggatcgtggagcgggggatggtcaagccaaagggaaaagtggtcgaccttggctgcggtcgtgggggatggtcctactatatggcaaccctgaagaacgtgacagaagttaaaggctacactaagggcgggcccggacacgaggaacctataccgatggctacctatggttggaatctcgtaaaactacatagtggcgtggatgtcttctacaagcccacagagcaagtggacactctgttgtgtgatatcggggagtctagctcaaacccaaccattgaagagggaagaacactgcgcgttctcaagatggtggaaccttggctttccagtaaacccgagttttgcatcaaggtcctgaatccttatatgccaaccgtgattgaagagttggagaaactgcagaggaagcacggcggtaacctcgtacggtgtcccttaagcagaaattctactcacgaaatgtactgggtgtccggggcctcaggaaacatcgttagctcggtcaatacgacatctaaaatgctgcttaaccgcttcaccactaggcatcgaaagcctacctatgagaaagacgtggatctgggcgcaggcacacggagtgtgtccacggaaaccgagaagccagacatgactattatcgggagaaggctacagcgcctccaggaggaacacaaggagacatggcattacgatcaagaaaatccctaccgtacctgggcttatcacggaagctacgaggccccgtcaactggttccgcctctagcatggtcaacggcgttgtgaaactgttgacaaagccttgggacgtaataccaatggtgacccagctggcgatgacagatactaccccctttgggcagcagcgggtcttcaaagaaaaggtggacacgagaacccctcaaccaaaacccggaacaaggatggttatgactaccacagctaattggctctgggcacttctgggcaagaagaaaaacccgcgcttatgcactcgagaggagtttattagtaaggtgcggtccaatgccgctatcggtgccgtcttccaggaagagcaggggtggaccagcgcatctgaagccgtgaacgactcaagattttgggagctggtagataaagaaagggctttgcaccaagagggaaagtgtgagagttgcgtttataacatgatgggcaaacgcgaaaagaagctcggcgagttcgggagagcgaaaggatcccgggccatctggtacatgtggctgggtgcaaggttcctagaatttgaggctcttggcttcctgaatgaagaccattggtttgggcgtgagaacagctggtctggagtggagggcgaaggtctccaccgactggggtatattttggaggaaatagataagaaagacggagatctgatgtacgccgacgatacggcaggctgggacacacgcatcaccgaggatgacctccagaatgaggaacttattactgagcagatggcccctcatcacaagatcctggctaaagccattttcaagttaacatatcagaacaaggtcgtgaaagtgctgagacccaccccacggggcgcggtcatggatatcatatcgaggaaggaccaacgcgggtcaggacaggttggtacttacggcttgaatacctttacaaacatggaagtgcagctcatcagacagatggaggcagaaggggtaattacgcaagatgacatgcagaatcctaaaggactgaaggagcgggtggagaaatggctaagggaatgcggcgtcgaccgacttaagcgtatggccatcagcggtgatgactgtgtggttaaacccctggatgagagattcgggacctccctcctgtttttgaacgacatgggaaaggtgcgcaaggatattccacagtgggaacccagtaaaggctggaagaattggcaggaggtccctttctgctctcatcactttcacaaaatcttcatgaaggacggccggagcttagtggtaccatgtaggaaccaagatgaactgatagggagagctcgcatttcccagggagccggttggtcactccgggagactgcatgccttggcaaagcttacgcccagatgtggagtctgatgtattttcataggcgagacctaagactggcttctatggccatctgtagcgcagttccgacagagtggttccccacctcccggactacatggtcaatccacgcgcatcaccagtggatgaccacggaagatatgctcaaggtgtggaatagggtctggattgaggacaaccctaatatgatagataagacaccagtgcacagctgggaagacatcccctacttggggaaacgcgaggacctgtggtgcggatctcttattggcctgtccagtcgtgccacctgggctaagaacatccatactgccattacccaagttagaaatctcatcggtaaagaagagtatgtggattacatgcctgcaatgaagcgatatagcgctccatcggagtccgaaggggtcttatga

SEQ ID NO: 15727 - RNA, 9867 nt, synthetic construct
  misc_feature 1..9867: note = derived and/or modified CDS sequence (opt3) from DENV-4__FJ639736__SS-prME
  source 1..9867: mol_type = other RNA
agcaccatgactctgctctgccttatccccactgccatggctttccacctgtccacgagagacggcgaacctttgatgattgtggcaaagcatgaaagggggcggccattactgtttaaaaccactgagggaataaacaagtgtactctaatcgccatggatctcggtgaaatgtgcgaggacaccgtcacatacaaatgtccgctgcttgttaataccgaacccgaggatattgactgctggtgtaacctgacttctacatgggtgatgtatggaacctgcacgcagtcaggggagcgccgacgtgaaaagagaagtgtagcgttgactcctcacagcggaatgggcctcgagaccagggctgaaacatggatgtcctctgagggtgcctggaaacatgcacagcgggtggagtcgtggatcctgcgcaatccagggttcgccctgctcgctggatttatggcatacatgattggccagactggcatccagagaaccgtcttctttgtgttaatgatgctggttgccccctcatatgggatgaggtgtgtgggagtcggtaaccgggatttcgtggaaggcgtaagcgggggagcttgggttgaccttgtgttggagcacggcggttgcgtcacaaccatggcccaggggaagcctacgctggattttgaactaactaagacaaccgcgaaagaggtggcactcctgcgcacttactgtatagaagcccttatcagtaatattacaaccgctacgcgatgcccaacccaaggagagccctatctgaaggaggaacaggaccagcagtacatctgtagaagggatgtggtcgaccggggctggggcaacgggtgcggattgttcggtaaaggcggggttgtgacatgcgccaagttttcctgttctggaaaaattactggcaatctcgtacaaatcgagaacctggaatataccgtggtcgtgacagttcataatggtgatactcacgcagtggggaacgacaccagcaatcacggcgtcacagctaccataactcctcgttccccatcagtggaggtaaagttaccggattacggagaactgacgctcgactgcgagccccgcagtggcattgacttcaacgagatgatccttatgaagatgaaaaagaaaacatggctggttcataagcagtggtttttggatctacctctgccatggaccgccggggcggacactagcgaagtgcactggaattacaaagagagaatggtcaccttcaaggtgccccatgccaaaaggcaggatgtcacagtgctcggatctcaggaaggtgcaatgcactccgctctggccggcgctaccgaggttgactcaggggatggaaaccacatgtttgccggccatcttaagtgtaaggtgcggatggaaaaactgcgaattaagggtatgagctatactatgtgcagtgggaaattctctatcgacaaggagatggcagagacacaacacggcacgaccgtagtcaaagtgaagtacgaaggagccggcgctccttgtaaggttccaatcgagattcgcgatgtgaataaagaaaaggtcgtggggagagtaatatccagcactcccttggcggagaacacaaactcggtgaccaatatcgagctcgaaccgcctttcggagactcttatattgttatcggtgtcggcaactccgcactgacattacattggtttaggaaagggtcaagtataggaaagatgttcgagagcacttaccggggcgccaaacgcatggctattctgggtgaaaccgcctgggattttgggtccgtgggcggactattcacgtctctcggcaaggcagtgcaccaggtctttgggagcgtttataccacaatgttcggaggcgtgtcatggatgatcagaatcctgattggttttcttgtgttgtggatcgggactaatagtaggaacacctccatggccatgacatgcattgctgtaggaggcataactctgttcctcggttttaccgtccaggccgacatgggctgtgtggttagctggtctgggcgtgagctgaagtgcggatcaggcatcttcgtggtcgataatgtgcatacgtggacagaacaatacaaatttcagcccgagagtccagcacggcttgcgagcgctattctgaacgcccacaaggacggggtttgtggaatccgatccaccactagattggagaatgtgatgtggaaacagatcacaaacgaactcaattatgtactgtgggagggcggtcacgacttaaccgtcgtggcaggggatgtgaagggagtcctgactaaaggcaagagggccctaacccctcccgtttctgacctcaagtactcgtggaaaacatggggtaaggctaaaattttcacgccagaagcccgcaacagcacctttctgatagatggccccgacacttccgagtgccctaatgaacggagagcatggaactcacttgaggtggaggattacgggttcggaatgttcacaaccaatatctggatgaagtttagggaaggcagttctgaggtatgtgaccatcgcttgatgagcgctgccattaaagatcagaaggcggtgcacgccgacatggggtattggatcgaatccagcaagaaccaaacatggcagattgagcgagctagcctgatcgaagtcaagacttgcctctggccaaagacccatacgctgtggtctaatggagtgttagagtcccagatgctgataccgaaaagttacgcaggccccttcagccagcacaactatcggcaaggttacgccacacagaccgttgggccttggcaccttggaaagttggagatcgattttggcgaatgcccaggtactaccgtgacaattcaggaggactgtgatcatcgtggcccctctctcagaactaccacagcttccgggaaactggtcacgcagtggtgctgtaggtcatgcaccatgcctccactacgcttcctgggagaagacggctgttggtatgggatggagatccggcccctcagtgagaaggaagagaacatggtgaaaagccaagttactgccggacagggcacatcggaaaccttttccatgggtctgctttgcttgactctgttcgtggaggaatgtttaagaaggcgagtcacacgcaagcacatgattctcgcagtagtgatcaccctgtgcgcgataattcttgggggactgacgtggatggatttgctccgggccctgatcatgctaggcgacactatgtctggcagaattgggggacagacccatctggctatcatggccgtttttaagatgagcccgggttacgtgctcggcgtcttcctgaggaaacttacatcacgtgagaccgcattgatggtgatagggatggctatgactacaaccctgagtatccctcacgacttaatggagctcattgatggaatctccctgggccttattctgctaaagatcgtaacacagtttgacaatactcaagtgggtaccctcgccctgtctttgacgttcatacgcagcacaatgtccctggtcatggcatggcggaccattatggccgttttatttgtggtgactctcatcccactgtgtagaacctcatgccttcagaaacagagccattgggtcgaaatcacagctctgattttgggggcgcaagccctccccgtgtatctgatgactctaatgaagggagcaagtaggcgatcttggcctctgaacgagggcatcatggctgttggccttgtatccctcctggggagcgccttgctgaaaaatgatgtgcccttagccggaccaatggtcgctggtggcctcctgcttgcagcctacgtgatgtcggggtcatctgcggacctgagtttggaaaaggctgccaacgttcagtgggatgagatggcagacattaccggatccagccctataatcgaagtgaagcaggatgaggacggctctttcagcattcgggatgtcgaggaaacgaatatgatcacactcctggtgaaactagccctgattaccgtatccggtctttaccccctcgctatcccagtcactatgacactgtggtatatgtggcaagtgaagacccaacgctcaggggcattgtgggacgttccgagtcctgccgcgactcagaaagctgccttaagcgagggagtgtacagaataatgcagaggggcctgtttggcaagacacaggtcggggtgggaatccacatggaaggtgttttccacaccatgtggcatgtgacgcggggctctgtcatttgtcacgagactgggcgactcgaaccctcctgggcagatgtgagaaacgacatgatctcatatggaggcggttggcgcctgggggataaatgggacaaggaggaggacgtacaagtgcttgccattgaaccaggaaagaatcccaaacatgttcagaccaagcctggcctgttcaaaacattgaccggcgagatcggggctgtcacactagattttaagccaggaacaagtggtagccccataattaacaggaaaggcaaggtgatcgggctgtacggaaatggcgtggtcaccaaatccggtgactatgtatctgccatcacgcaggcagaacgtattggggagcctgattacgaggtggacgaagatatattccggaagaagagactcacaatcatggacctgcacccgggagctggcaaaactaagaggattcttccatcgatcgttcgcgaggccttaaaacgaagactgcggaccctcattttggcgcccacaagggtggtcgccgcagaaatggaggaagctctgcgcggcctccctatccgttatcagaccccagccgtgaagtcagagcatactgggagagagatagttgatctgatgtgccacgctacctttacaacgcggcttctgtcatccactagggtgcccaactacaatttgatcgtcatggacgaagcacacttcaccgatcctagttctgtggccgcccgcggatacattagcacacgagtagagatgggtgaagctgcggcaatctttatgaccgccactccgcccggcgctacagacccattccctcaatccaactcacccattgaggatatcgaaagagagataccagagcggtcttggaataccgggtttgactggattacggactatcagggaaaaactgtgtggttcgttcctagcatcaaggccggcaacgatatcgcaaattgcctaaggaagagtggtaaaaaggtcattcagctgtcccgcaaaacatttgacaccgaataccccaagaccaaactcactgattgggacttcgtggtgacaaccgatatcagcgagatgggggccaactttagagctggcagggtcatagacccacggcgttgtttaaagccggttattctgacagatggacctgaacgcgtgatccttgcgggccccattccagtaactcccgcctctgcagctcaacgaagagggaggatcggacggaaccctgcccaggaggacgatcagtatgtgttctcaggtgacccactgaagaatgatgaagaccatgcacactggacggaggccaaaatgctcttggataacatatacacccccgagggcattatccctacactgttcgggccggaacgcgagaagactcaggctatcgacggagaatttagactcaggggcgagcaacggaaaaccttcgtcgagctgatgcgaagaggtgaccttccagtgtggctatcctataaggttgccagtgcggggattagctacaaagatcgcgaatggtgctttacaggcgagaggaataaccagatcctggaagagaatatggaagtggagatttggacccgggagggagaaaagaagaaattgcgtcccagatggttagacgcaagggtctatgccgatcctatggctctgaaggacttcaaagagtttgcctcgggccgcaagtctataactctcgatatcctgacggaaattgcttcccttcccacctacctgagctcacgggcaaaactcgccttggacaacatcgtaatgctgcatacaactgagcgagggggcagagcttaccagcacgccctaaatgaactgccagagagtctcgagacccttatgctggtggcattattgggtgcgatgacagccggcatcttcctgtttttcatgcaggggaagggaattggcaagctctctatgggtctgataaccatcgctgttgcctccgggcttctgtgggtggcagaaattcaacctcagtggatcgctgccagcattatcctcgagtttttcttgatggtcctgttaatacccgaaccagagaaacagaggactcctcaggataaccaactaatctatgtgattctgacaatcctcacgattatcggccttatagcagccaatgaaatgggactgattgagaagaccaaaactgactttggcttctaccaggtcaagacagagaccaccatcttggatgtggacctgcgcccggcttcagcgtggacactctatgccgttgcaactacgattctgacccccatgcttcggcacacaatcgaaaacacaagtgctaatctcagcctggccgccatagcaaaccaggctgccgtgttgatggggctgggaaaaggctggccattacatagaatggatctaggtgtacctctgctcgcgatggggtgttactcccaggtgaatcccaccacacttaccgcttctctggtcatgttgctggttcactatgccatcattggaccaggcctccaagcaaaggccactcgtgaggctcagaaaaggacggcagccggtatcatgaagaaccctacagtggacggcattaccgtcatcgatctggaacccataagctacgacccgaagtttgagaaacagcttgggcaagtgatgttactggtactctgcgcgggacagttgctgctaatgcggactacctgggctttctgtgaggtgctgacactcgccactggcccaattcttaccctgtgggaagggaatcctggacgcttctggaacacaacgatcgcagtttccaccgccaacatctttcgaggctcatatttggctggtgccgggctggcattctctctcattaagaatgctcagactcccagaaggggaacaggcaccactggtgagacactgggcgaaaaatggaagcggcagttaaacagtcttgaccgcaaagagtttgaagagtacaagagatcggggatcctggaggtggataggaccgaagccaagagcgcgctcaaagacggatccaagataaaacatgccgtctctcgaggctcaagcaagattcggtggatcgtggagcgtgggatggtcaaaccaaagggaaaggtggttgatctaggctgcggtagagggggatggtcctactatatggcaacgctgaaaaatgtaaccgaagtgaagggctacacaaaaggcgggcccggacacgaggaacctattccgatggctacttatggttggaacttggtcaagctgcatagtggcgtggacgttttctacaaacccaccgagcaagtggatacactcctttgtgacatcggggagtctagctcaaatccaactatagaagagggacgcaccctgagggtcttgaagatggtggaaccttggctgtccagtaagcccgagttttgcatcaaagtactcaacccttatatgccaacagtgattgaagagttagagaagctgcagcggaaacacggcggtaatcttgttagatgtcccctgagccgcaactctacccacgaaatgtactgggtctccggggcctcaggaaatatcgtgagctcggtgaacactacgtctaagatgctactcaataggttcacaacccgacatcggaaacctacttatgagaaggatgtcgacctgggcgcaggcaccagaagtgtttccacagaaacggagaaaccagatatgaccattatcgggaggcgcttgcagcgtctgcaggaggaacacaaggagacttggcattacgaccaagaaaacccctaccggacatgggcttatcacggaagctacgaggccccgtcaaccggttccgcctctagcatggtgaatggcgtagtgaagctccttactaaaccttgggatgtcattccaatggtgacacagctggcgatgaccgacacaactccctttgggcagcagagagttttcaaggaaaaagtggacaccaggacgcctcaaccaaagcccggaacccgcatggtcatgacaactaccgctaactggttatgggcactgttgggcaaaaagaagaatccgcgactctgcacacgggaggagtttatcagtaaagtgagatccaacgccgctataggtgccgtattccaggaagaacaggggtggactagcgcatctgaagccgttaatgattcaaggttttgggagctggtggacaaggaacgcgctctacaccaagagggaaaatgtgagagttgcgtctataacatgatgggcaagagagagaagaaacttggcgagttcgggcgggcgaaaggatccagggccatttggtacatgtggctgggtgcacgttttctcgagttcgaggctctgggcttcttgaacgaagatcattggtttgggcgagagaatagctggtctggagtggagggcgaaggtctgcaccgcctcgggtatatccttgaggaaatcgacaaaaaggatggagacctgatgtacgccgatgacaccgcaggctgggatacgagaattacagaggacgatttacagaacgaggaactgataaccgagcagatggcccctcatcacaaaatcttggctaaggccattttcaaactcacttatcagaataaggtggtcaaggttctgcggcccacaccaaggggcgcggtgatggacatcatttcgcgcaaagatcaaagagggtcaggacaggtaggtacctacggcctaaacacttttaccaatatggaagtgcagcttatccggcagatggaggcagaaggggtcataacacaagacgacatgcagaaccctaagggactgaaagagagggtggagaagtggctccgagaatgcggcgttgatcgtctgaaaagaatggccatcagcggtgacgattgtgtggtcaagcccttggacgagcgcttcgggacgtccttactgtttctcaatgatatgggaaaagtgcggaaggacattccacagtgggaacccagtaagggctggaaaaactggcaggaggtacctttctgctctcatcactttcacaagatcttcatgaaagatggcaggagccttgttgtgccatgtagaaatcaagacgaactgattgggcgcgctcggatctcccagggagccggttggtcactaagggagaccgcatgcctgggcaaggcttacgcccagatgtggagtctcatgtattttcatcgaagagatttgcggctggcttctatggccatatgtagcgcagtcccgactgagtggttccccacatccaggaccacttggtcaattcacgcgcatcaccagtggatgacaaccgaagacatgcttaaagtgtggaaccgcgtttggatcgaggataatcctaacatgatcgacaagacgccagtgcacagctgggaagacattccctacctggggaagcgtgaggatctctggtgcggatctttaataggcctgtccagtagagccacatgggctaaaaatatccataccgccattactcaagtccgaaacttgatcggtaaggaagagtatgtggactacatgcctgtaatgaaaaggtatagcgcaccatcggagtccgaaggggtgctgtga

SEQ ID NO: 15728 - RNA, 9867 nt, synthetic construct
  misc_feature 1..9867: note = derived and/or modified CDS sequence (opt3) from DENV-4__FJ639737__SS-prME
  source 1..9867: mol_type = other RNA
tcaaccatcactctgctctgccttattcccactgtgatggccttccacctgtccacgagagacggagaacctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttatcaataccgaacccgaggatattgactgctggtgtaacctgacttctacatgggtgatgtatggaacctgcacgcagtcaggggagcgccgacgtgaaaagagaagtgtagccttgactcctcacagcggaatgggcctcgagaccagggcggaaacatggatgtcctctgagggtgcttggaaacatgcccagcgggtggagtcgtggatcctgcgcaatccagggttcgcactgctcgccggatttatggcttacatgataggccagactggcatccagagaaccgtcttctttgtgttaatgatgctggttgcaccctcatatgggatgaggtgtgtgggagtcggtaaccgggatttcgtggaaggcgtaagcgggggagcctgggttgaccttgtgttggagcacggcggttgcgtcacaaccatggctcaggggaagcctacgctggattttgaactaactaagacaaccgccaaagaggtggcgctcctgcgcacttactgtattgaagcacttatcagtaatattacaaccgccacgcgatgcccaacccaaggagagccctatctgaaggaggaacaggaccagcagtacatctgtagaagggatgtggtcgaccggggctggggcaacgggtgcggattgttcggtaaaggcggggttgtgacatgcgctaagttttcctgttctggaaaaataactggcaatctcgtacaaattgagaacctggaatataccgtggtcgtgacagttcataatggtgatactcacgccgtggggaacgacaccagcaatcacggcgtcacagcaaccatcactcctcgttccccatcagtggaggtaaagttaccggattacggagaactgacgctcgactgcgagccccgcagtggcattgacttcaacgagatgatccttatgaagatgaaaaagaaaacatggctggttcataagcagtggtttttggatctacctctgccatggaccgctggggccgacactagcgaagtgcactggaattacaaagagagaatggtcaccttcaaggtgccccatgcgaaaaggcaggatgtcacagtgctcggatctcaggaaggtgccatgcactccgcactggctggcgccaccgaggttgactcaggggatggaaaccacatgtttgctggccatcttaagtgtaaggtgcggatggaaaaactgcgaatcaagggtatgagctatactatgtgcagtgggaaattctctattgacaaggagatggccgagacacaacacggcacgaccgtagtcaaagtgaagtacgaaggagcaggcgccccttgtaaggttccaatagagatccgcgatgtgaataaagaaaaggtcgtggggagagtaatttccagcactcccttggctgagaacacaaactcggtgaccaatatcgagctcgaaccgcctttcggagactcttatatagttattggtgtcggcaactccgcgctgacattacattggtttaggaaagggtcaagtatcggaaagatgttcgagagcacttaccggggcgcaaaacgcatggccatcctgggtgaaaccgcttgggattttgggtccgtgggcggactattcacgtctctcggcaaggccgtgcaccaggtctttgggagcgtttataccacaatgttcggaggcgtgtcatggatgattagaatcctgattggttttcttgtgttgtggatagggactaatagtaggaacacctccatggcaatgacatgcatcgccgtaggaggcattactctgttcctcggttttaccgtccaggctgacatgggctgtgtggttagctggtctgggcgtgagctgaagtgcggatcaggcatcttcgtggtcgataatgtgcatacgtggacagaacaatacaaatttcagcccgagagtccagcccggcttgcaagcgcgatcctgaacgctcacaaggacggggtttgtggcattcgatccaccactagattggagaatgtgatgtggaaacagataacaaacgaactcaattatgtactgtgggagggcggtcacgacttaaccgtcgtggccggggatgtgaagggagtcctgactaaaggcaagagggcactaacccctcccgtttctgacctcaagtactcgtggaaaacatggggtaaggccaaaatcttcacgccagaagctcgcaacagcacctttctgattgatggccccgacacttccgagtgccctaatgaacggagagcctggaactcacttgaggtggaggattacgggttcggaatgttcacaaccaatatctggatgaagtttagggaaggcagttctgaggtatgtgaccatcgcttgatgagcgcagctattaaagatcagaaggccgtgcacgcggacatggggtattggatcgaatccagcaagaaccaaacatggcagatagagcgagccagcctgatcgaagtcaagacttgcctctggccaaagacccatacgctgtggtctaatggagtgttagagtcccagatgctgattccgaaaagttacgctggccccttcagccagcacaactatcggcaaggttacgcaacacagaccgttgggccttggcaccttggaaagttggagatcgattttggcgaatgcccaggtactaccgtgacaattcaggaggactgtgatcatcgtggcccctctctcagaactaccacagcctccgggaaactggtcacgcagtggtgctgtaggtcatgcaccatgcctccactacgcttcctgggagaagacggctgttggtatgggatggagatccggcccctcagtgagaaggaagagaacatggtgaaaagccaagttactgctggacagggcacatcggaaaccttttccatgggtctgctttgcttgactctgttcgtggaggaatgtttaagaaggcgagtcacacgcaagcacatgatactcgccgtagtgattaccctgtgcgcaatcattcttgggggactgacgtggatggatttgctccgggcgctgatcatgctaggcgacactatgtctggcagaatagggggacagacccatctggccatcatggctgtttttaagatgagcccgggttacgtgctcggcgtcttcctgaggaaacttacatcacgtgagaccgccttgatggtgattgggatggcaatgactacaaccctgagtatccctcacgacttaatggagctcattgatggaatctccctgggccttatactgctaaagattgtaacacagtttgacgatactcaagtgggtaccctcgctctgtctttgacgttcatccgcagcacaatgtccctggtcatggcctggcggaccatcatggcagttttatttgtggtgactctcattccactgtgtagaacctcatgccttcagaaacagagccattgggtcgaaatcacagccctgattttgggggctcaagcgctccccgtgtatctgatgactctaatgaagggagccagtaggcgatcttggcctctgaatgagggcataatggcagttggccttgtatccctcctggggagcgctttgctgaaaaacgacgtgcccttagccggaccaatggtcgccggtggcctcctgcttgctgcatacgtgatgtcggggtcatctgccgatctgagtttggaaaaggcggcttccgttcagtgggacgagatggccgatatcaccggaagctctcctattatcgaagtgaagcaggacgaggatggcagcttctccattcgggacgtcgaggaaacgaatatgatcacactcctggtgaaactagcactgataaccgtatcaggtctttaccccctcgccatcccagtcactatgacactgtggtatatgtggcaagtgaagacccaacgcagtggggctttgtgggatgttccgagccctgcagccactcagaaagcggctttatctgagggagtgtacagaattatgcagaggggcctgtttggcaagacacaggtcggggtgggaatccacattgaaggtgttttccacaccatgtggcatgtgacgcggggctccgtcatctgtcacgagactgggcgactcgaaccctcatgggccgacgtgagaaacgatatgataagttatggaggcggttggcgcctgggggacaaatgggacaaggaggaggatgtacaagtgcttgcaattgaaccaggaaagaatcccaaacatgttcagaccaagcctggcctgttcaaaacattgaccggcgagatcggggccgtcacactagactttaagccaggaactagcggttcccccatcattaacaggaaaggcaaggtgatagggctgtacggaaatggcgtggtcaccaaatctggtgattatgtatcggctatcacgcaggccgaacgtattggggagcctgactacgaggtggatgaagacatcttccggaagaagagactcacaattatggatctgcacccgggagcaggcaaaactaagaggatccttccaagcatagttcgcgaggctttaaaacgaagactgcggaccctcatcttggcccccacaagggtggtcgcggccgaaatggaggaagcactgcgcggcctccctattcgttatcagaccccagctgtgaagtcagagcatactgggagagagatcgttgacctgatgtgccacgccacctttacaacgcggcttctgtccagtactagggtgcccaactacaatttgattgtcatggatgaagctcacttcaccgacccttctagcgtggcagcccgcggatacatctccacacgagtagagatgggtgaagccgctgcgatatttatgaccgcaactccgcccggcgccacagatccattccctcaatcaaactctcccattgaggacatcgaaagagagatcccagagcggagctggaataccgggtttgactggattacggattatcagggaaaaactgtgtggttcgttcctagtatcaaggctggcaacgacatagccaattgcctaaggaagtccggtaaaaaggtcattcagctgagccgcaaaacatttgataccgaataccccaagaccaaactcactgactgggatttcgtggtgacaaccgacatctctgagatgggggcaaactttagagccggcagggtcattgatccacggcgttgtttaaagccggttatcctgacagacggacctgaacgcgtgatacttgctggccccattccagtaactcccgcgtcagccgcacaacgaagagggaggatcggacggaatcctgctcaggaggatgaccagtatgtgttctccggtgatccactgaagaacgacgaagatcatgcccactggacggaggcaaaaatgctcttggacaacatctacacccccgagggcattatccctacactgttcgggccggaacgcgagaagactcaggccattgacggagaatttagactcaggggcgagcaacggaaaaccttcgtcgagctgatgcgaagaggtgatcttccagtgtggctaagttataaggttgctagcgccgggatatcgtacaaagaccgcgaatggtgctttacaggcgagaggaataaccagatcctggaagagaatatggaagtggagatttggacccgggagggagaaaagaagaaattgcgtcccagatggttagatgcgagggtctatgcagaccctatggccctgaaggatttcaaagagtttgcttctggccgcaagtccatcactctcgacatcctgacggaaattgccagccttcccacctacctgtcaagtcgggctaaactcgcattggataacatagtaatgctgcatacaactgagcgagggggcagagcctaccagcacgctctaaatgaactgccagagtctctcgagacccttatgctggtggccttattgggtgcaatgacagcgggcatcttcctgtttttcatgcaggggaagggaattggcaagctctccatgggtctgatcaccattgccgttgctagcgggcttctgtgggtggccgaaatccaacctcagtggatagcagcttcaatcattctcgagtttttcttgatggtcctgttaatccccgaaccagagaaacagaggactcctcaggacaaccaactaatttatgtgatcctgacaatactcacgattatcggccttattgccgcaaatgaaatgggactgatcgagaagaccaaaactgattttggcttctaccaggtcaagacagagaccaccatattggacgtggatctgcgcccggccagtgcttggacactctatgcggttgccactacgatcctgacccccatgcttcggcacacaattgaaaacactagcgcaaatctctccctggctgccatcgccaaccaggcagctgtgttgatggggctgggaaaaggctggccattacatagaatggacctaggtgtacctctgctcgccatggggtgttactctcaggtgaatcccaccacacttaccgcgagcctggtcatgttgctggttcactatgctattatcggaccaggcctccaagccaaggcaactcgtgaggcccagaaaaggacggctgcaggtataatgaagaaccctacagtggatggcattaccgtcatcgacctggaacccatctcctacgacccgaagtttgagaaacagcttgggcaagtgatgttactggtactctgcgccggacagttgctgctaatgcggactacctgggcgttctgtgaggtgctgacactcgctactggcccaattcttaccctgtgggaagggaatcctggacgcttctggaacacaacgatcgccgtttcaaccgcaaatatatttcgaggctcttatttggccggtgctgggctggccttcagtctcattaagaacgcacagactcccagaaggggaacaggcaccactggtgagacactgggcgaaaaatggaagcggcagttaaactcgcttgatcgcaaagagtttgaagagtacaagagaagcgggatcctggaggtggacaggaccgaagctaagtccgccctcaaagatggatctaagattaaacatgcggtctcacgaggcagctccaagatccggtggatagtggagcgtgggatggtcaaaccaaagggaaaggtggttgacctaggctgcggtagagggggatggagttactatatggccacgctgaaaaatgtaaccgaagtgaagggctacacaaaaggcgggcccggacacgaggaacctatcccgatggcaacttatggttggaacttggtcaagctgcattctggcgtggatgttttctacaaacccattgagcaagtggacaccctcctttgtgatatcggggagagctcatccaatccaacaattgaagagggacgcactctgagggtcttgaagatggtggaaccttggctgagtagcaagcccgagttttgcatcaaagtactcaacccttatatgccaaccgtgattgaagagttagagaagctgcagcggaaacacggcggtaatcttgttagatgtcccctgtctcgcaactccacacacgaaatgtactgggtctcaggggctagcggaaatatcgtgtcgtctgtgaacaccacaagtaagatgctactcaataggttcacgacacgacatcggaaacctacctatgagaaggacgtcgatctgggcgccggcactagatccgttagcaccgaaacagagaaaccagacatgacgataattgggaggcgcttgcagcgtctgcaggaggaacacaaggagacctggcattacgatcaagaaaacccctaccggacttgggcatatcacggatcatacgaggctccgtccacaggttctgccagcagtatggtgaatggcgtagtgaagctccttaccaaaccttgggacgtcatcccaatggtgactcagctggccatgacagacaccacaccctttgggcagcagagagttttcaaggaaaaagtggatactaggacccctcaaccaaagcccggaacgcgcatggtcatgaccacaactgcgaactggttatgggctctgttgggcaaaaagaagaatccgcgactctgcacccgggaggagtttatctccaaagtgagaagcaacgcagccattggtgctgtattccaggaagaacaggggtggacatctgcctcagaagcagttaatgacagtaggttttgggagctggtggataaggaacgcgccctacaccaagagggaaaatgtgagtcctgcgtctataacatgatgggcaagagagagaagaaacttggcgagttcgggcgggctaaaggaagcagggcgatatggtacatgtggctgggtgcccgttttctcgagttcgaggcactgggcttcttgaatgaagaccattggtttgggcgagagaactcttggtcgggagtggagggcgaaggtctgcaccgcctcgggtatatccttgaggaaattgataaaaaggacggagatctgatgtacgctgacgatactgccggctgggacaccagaatcacggaggatgacttacagaacgaggaactgattacagagcagatggcacctcatcacaaaatcttggccaaggctatattcaaactcacctatcagaataaggtggtcaaggttctgcggcccactccaaggggcgccgtgatggatatcatttcacgcaaagaccaaagagggagcggacaggtaggtacatacggcctaaacacctttactaatatggaagtgcagcttatccggcagatggaggcggaaggggtcattacccaagacgatatgcagaaccctaagggactgaaagagagggtggagaagtggctccgagaatgcggcgttgaccgtctgaaaagaatggcaatctccggtgatgactgtgtggtcaagcccttggatgagcgcttcgggacaagtttactgtttctcaatgacatgggaaaagtgcggaaggatataccacagtgggaaccctctaagggctggaaaaactggcaggaggtacctttctgcagccatcactttcacaagattttcatgaaagacggcaggtcccttgttgtgccatgtagaaatcaagatgaactgatcgggcgcgcccggatctcacagggagctggttggagtctaagggagacggcctgcctgggcaaggcatacgctcagatgtggtctctcatgtattttcatcgaagagacttgcggctggccagcatggctatttgttccgccgtcccgaccgagtggttccccacttcaaggacaacctggagcatacacgcacatcaccagtggatgactacagaagatatgcttaaagtgtggaaccgcgtttggatcgaggacaatcctaacatgattgacaagaccccagtgcactcttgggaagatatcccctacctggggaagcgtgaggacctctggtgcggatccttaattggcctgagtagcagagcgacgtgggccaaaaatatccatacagctataacccaagtccgaaacttgatcggtaaggaagagtatgtggattacatgcctgtaatgaaaaggtattcggccccatccgagtctgaaggggtgctgtga

SEQ ID NO: 15729 - RNA, 9867 nt, synthetic construct
  misc_feature 1..9867: note = derived and/or modified CDS sequence (opt3) from DENV-4__FJ639738__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccgctggggccgacactagcgaagtccactggaattacaaagagagaatggtgaccttcaaggtcccccatgcgaaaaggcaggatgtgacagttctcggatctcaggaaggtgccatgcactccgcactggctggcgccaccgaggtggactcaggggatggaaaccacatgtttgctggccatcttaagtgtaaggtacggatggaaaaactgcgaatcaagggtatgagctatactatgtgcagtgggaaattctctatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatctccagcactcccttggctgagaacacaaactcggttaccaatattgagctcgaaccgcctttcggagactcttatatcgtcataggtgtgggcaactccgcgctgacattacattggtttaggaaagggtcaagtattggaaagatgttcgagagcacttaccggggcgcaaaacgcatggccatcctgggtgaaaccgcttgggattttgggtccgtgggcggactattcacgtctctcggcaaggccgtccaccaggtttttgggagcgtgtataccacaatgttcggaggcgtgtcatggatgatcagaattctgatcggttttcttgtattgtggattgggactaatagtaggaacacctccatggcaatgacatgcatagccgtcggaggcatcactctgttcctcggttttaccgtgcaggctgacatgggctgtgttgtgagctggtctgggcgtgagctgaagtgcggatcaggcattttcgtcgtggataatgttcatacgtggacagaacaatacaaatttcagcccgagagtccagcccggcttgcaagcgcgatcctgaacgctcacaaggacggggtgtgtggaatccgatccaccactagattggagaatgtaatgtggaaacagattacaaacgaactcaattatgtcctgtgggagggcggtcacgacttaaccgtggtggccggggatgtcaagggagttctgactaaaggcaagagggcactaacccctcccgtgtctgacctcaagtactcgtggaaaacatggggtaaggccaaaatattcacgccagaagctcgcaacagcacctttctgatcgatggccccgacacttccgagtgccctaatgaacggagagcctggaactcacttgaggtagaggattacgggttcggaatgttcacaaccaatatttggatgaagtttagggaaggcagttctgaggtgtgtgaccatcgcttgatgagcgcagctatcaaagatcagaaggccgtccacgcggacatggggtattggattgaatcctcaaaaaaccaaacatggcagatcgagcgagccagcctgatagaagtgaagacttgcctctggccaaagacccatacgctgtggtctaatggagttttagagtcccagatgctgatcccgaaaagttacgctggccccttcagccagcacaactatcggcaaggttacgcaacacagaccgtggggccttggcaccttggaaagttggagattgattttggcgaatgcccaggtactaccgtcacaatccaggaggactgtgatcatcgtggcccctctctcagaactaccacagcctccgggaaactggtgacgcagtggtgctgtaggtcatgcaccatgcctccactacgcttcctgggagaagacggctgttggtatgggatggagattcggcccctcagtgagaaggaagagaacatggttaaaagccaagtgactgctggacagggcacatcggaaaccttttccatgggtctgctttgcttgactctgttcgtcgaggaatgtttaagaaggcgagtaacacgcaagcacatgatcctcgccgtggttataaccctgtgcgcaattatccttgggggactgacgtggatggatttgctccgggcgctgattatgctaggcgacactatgtctggcagaatcgggggacagacccatctggccataatggctgtgtttaagatgagcccgggttacgtcctcggcgtgttcctgaggcgtcttacatcacgcgagaccgccttgatggtaatcgggatggcaatgactacaaccctgagtattcctcacgacttaatggagctcatcgatggaatttccctgggccttatcctgctaaaaatagtgacacagtttgacaatactcaagtcggtaccctcgctctgtctttgacgttcattcggagcacaatgtccctggttatggcctggagaaccatcatggcagtgttatttgtggtcactctcatcccactgtgtaggacctcatgccttcagaagcagagccattgggtggaaattacagccctgatcttgggggctcaagcgctccccgtttatctgatgactctaatgaaaggagccagtcgacggtcttggcctctgaacgagggcattatggcagtaggccttgtgtccctcctggggagcgctttgctgaagaatgatgtccccttagccggaccaatggtggccggtggcctcctgcttgctgcatacgttatgtcggggtcatctgccgacctgagtttggaaaaagcggctaacgtgcagtgggatgagatggccgacataaccggatccagccctatcattgaagtcaagcaggatgaggacggctctttcagcatccgcgatgtggaggaaacgaatatgattacactcctggtaaagctagcactgatcaccgtctccggtctttaccccctcgccataccagtgactatgacactgtggtatatgtggcaggttaaaacccaaagatcaggggctttgtgggacgtgccgagtcctgcagccactcagaaggcggctttaagcgagggagtctacaggatcatgcagcggggcctgtttggcaaaacacaggtgggggttggaattcacatggaaggtgtgttccacaccatgtggcatgtcacgcgaggctctgtgatctgtcacgagactgggagactcgaaccctcctgggccgatgtacgcaacgacatgatttcatatggaggcggttggaggctgggggataagtgggacaaagaggaggacgtgcaagttcttgcagtcgaaccaggaaagaatcccaagcatgtgcagaccaaacctggcctgttcaagacaatcaccggcgagataggggccgtgacattggattttaaaccaggaactagtggtagccccattatcaaccgtaagggcaaagtcatcgggctatacggaaatggcgtagtgaccaagtccggtgactatgtttctgctattacgcaggccgaacggataggggagcctgattacgaggtggacgaagatatcttcagaaaaaagaggctgacaattatggacctccacccgggagcaggcaagactaaacgcatcctgccatcgattgtccgagaggctcttaagagacggttaaggaccctgatcctcgcccccacacgcgtggttgcggccgaaatggaggaagcattgcgtggcctgcctataagatatcagaccccagctgtgaaaagcgagcatactgggcgggagatcgtcgatctcatgtgccacgccacctttacaacgaggctgctttcatccactcgcgtgcccaactacaatctgattgtaatggacgaagctcacttcaccgatcctagttctgtggcagcccgaggatacatcagcacaagagttgagatgggtgaagccgctgcgatttttatgaccgcaactccgcccggcgccacagacccattccctcaatccaactcacccatcgaggatatagaacgggagattccagagaggtcttggaataccgggtttgactggatcacggactatcagggaaagactgtctggttcgtgcctagcatcaaagctggcaacgatattgccaattgcttgcgcaagagtggtaagaaagtgatccagctatccagaaagacatttgacaccgaataccccaaaaccaagctgactgattgggacttcgtcgttacaaccgatataagcgagatgggggcaaactttagggccggccgggtgattgacccacgtcgctgtctcaaaccggtaatcttaacagatggacctgaacgagtgattctggctggccccatcccagtcactcccgcgtctgccgcacaaagaagggggcggataggacgcaaccctgctcaggaggacgatcagtatgtgttctcaggtgacccacttaagaatgatgaagaccatgcccactggacggaggcaaagatgctgctcgataacatttacacccccgagggcatcatccctacattgttcgggccggaaagagagaaaactcaggccattgacggagaatttaggctgcggggcgagcaacgaaagaccttcgttgagctcatgagacgcggtgacctgccagtgtggctttcctataaagtcgctagtgccgggatcagctacaaggatagggaatggtgctttacaggcgagcggaataaccagattctagaagagaatatggaagtagagatatggacccgtgagggagaaaaaaagaagctgagacccaggtggttggacgcgcgcgtgtatgcagatcctatggccttaaaagacttcaaggagtttgcttcgggccggaaatctatcactctggatattctcacggaaatcgcctccctgcccacctaccttagctcacgagctaagctggcactcgacaacatcgttatgttgcatacaactgagagagggggaagggcctaccagcacgctctgaatgaactaccagagagtctggagaccctcatgcttgtggccctgttaggtgcaatgacagcgggcattttcttgtttttcatgcaggggaaaggaataggcaagctgtctatgggtctcatcaccattgccgtcgcttccgggctgctttgggtggccgaaatccaacctcagtggattgcagctagcatcatactggagtttttcctcatggtcttgctgatccccgaaccagagaagcagcgcactcctcaggataaccaattaatttatgtgatcctaacaattctgacgatcataggcctcattgccgcaaatgaaatgggacttatcgagaaaaccaagactgactttggcttctaccaggttaaaacagagaccaccattctggatgtggacttgcggccggcctcagcttggacactgtatgcggtagccactacgatcctcacccccatgctgagacacacaatagaaaacactagtgcaaatcttagcctcgctgccatcgccaaccaggcagctgtgctgatggggttgggaaagggctggccactgcatcgtatggatttaggtgtccctctactggccatggggtgttactcccaggttaatcccaccacactcaccgcgtctcttgtgatgctgttggtccactatgctattatcggaccaggcctgcaagccaaagcaactagggaggcccagaagcggacggctgcaggtattatgaaaaaccctacagtggacggcatcaccgtaatagatctcgaacccattagctacgacccgaagtttgagaagcagctggggcaagtgatgcttttagttctgtgcgccggacagctcttgctgatgcgcactacctgggcgttctgtgaggtgctaacactggctactggcccaatcctcaccctttgggaagggaatcctggacgattctggaacacaacgatcgccgtctccaccgcaaacatttttagaggctcatatctggccggtgctgggttggccttctctctgatcaaaaatgcacagactcccaggcggggaacaggcaccactggtgagacactcggcgaaaagtggaaacgccagctgaacagtttagacagaaaggagtttgaagagtacaaaaggtcggggatacttgaggtggatcgaaccgaagctaagagcgccctgaaggacggatccaaaattaagcatgcggtctctcggggctcaagcaaaatccgttggattgtggagagagggatggttaagccaaaaggaaaggtagtggatctcggctgcggtcgcgggggatggtcctactatatggccacgctaaagaatgtcaccgaagtgaaaggctacacaaagggcgggcccggacacgaggaacctatcccgatggcaacttatggttggaacctggttaaattgcatagtggcgtggacgtcttctacaagcccaccgagcaagtggatacactgctctgtgacataggggagtctagctcaaatccaactatcgaagagggaaggacccttcgggtactgaaaatggtggaaccttggttgtccagtaagcccgagttttgcattaaggttctgaacccttatatgccaacagtcatcgaagagctcgagaaattacagagaaagcacggcggtaatctggtgcgctgtccccttagcaggaactctacccacgaaatgtactgggtgtccggggcttcaggaaatattgtcagctcggttaacactacgtctaaaatgctgctaaatcgattcacaacccggcatagaaagcctacttatgagaaagatgtggacctcggcgccggcaccaggagtgtatccacagaaacggagaagccagatatgaccatcattgggcgccgtctgcagcggttgcaggaggaacacaaagagacttggcattacgaccaagaaaacccctacagaacatgggcatatcacggaagctacgaggctccgtcaaccggttccgcctctagcatggtgaatggcgtcgtgaagctgctcactaagccttgggatgttatcccaatggtgacacagcttgccatgaccgacacaactccctttgggcagcagagggtcttcaaagaaaaggtggacacccgcacgcctcaaccaaaacccggaacccgaatggtaatgacaactaccgcgaactggctgtgggctttactgggcaagaaaaagaatccgcggttgtgcacaagagaggagtttataagtaaggttaggtccaacgcagccattggtgctgtgttccaggaagagcaggggtggactagcgcctctgaagcagtcaatgattcacgcttttgggagctcgtggacaaagaaagagccctgcaccaagagggaaagtgtgagagttgcgtgtataacatgatgggcaaacgggaaaagaaactaggcgagttcgggagggctaagggatcccgtgcgatctggtacatgtggcttggtgcccgatttctggaattcgaggcactcggcttcctgaacgaagatcattggtttgggcgcgagaatagctggtctggagtcgagggcgaaggtttgcacagactggggtatatcctcgaggaaattgacaagaaagatggagaccttatgtacgctgatgacaccgccggctgggatacgcggataacagaggacgatctgcagaacgaggaattaatcaccgagcagatggcacctcatcacaagattctggccaaagctatcttcaagttgacttatcagaataaagttgtgaaggtactcaggcccacaccacgcggcgccgtgatggacattatctcgagaaaggatcaacgggggtcaggacaggtcggtacctacggcctgaacacttttaccaatatggaagtgcagctaataaggcagatggaggcggaaggggttatcacacaagacgacatgcagaaccctaaaggacttaaggagcgagtggagaaatggctgcgtgaatgcggcgtcgatagactcaagcgcatggcaattagcggtgacgattgtgtggtaaaacccctggacgagcggttcgggacgtccttgttatttctgaatgatatgggaaaggttaggaaagacatcccacagtgggaacccagtaagggctggaagaactggcaggaggtgcctttctgctctcatcactttcacaaaattttcatgaaggatggcagaagcctcgtcgtgccatgtcgcaatcaagacgaacttatcgggcgggccaggatatcccagggagctggttggtcactgcgagagaccgcctgcctaggcaaagcatacgctcagatgtggagtctgatgtattttcatagacgggatctcaggttggcctctatggctatttgtagcgccgttccgactgagtggttccccacatcccgcaccacttggtcaatccacgcacatcaccagtggatgacaaccgaagacatgctgaaggtgtggaaccgtgtctggatcgaggataatcctaacatgattgacaaaacgccagtgcacagctgggaagacataccctaccttgggaagagagaggatctgtggtgcggatctctcatcggcttatccagtcgagcgacatgggccaagaatattcataccgctatcactcaagtaaggaacctgattggtaaagaagagtatgtggactacatgcctgtcatgaagcggtatagcgccccatcggagtccgaaggggttttgtga

SEQ ID NO: 15730 - RNA, 9867 nt, synthetic construct
  misc_feature 1..9867: note = derived and/or modified CDS sequence (opt3) from DENV-4__FJ639739__SS-prME
  source 1..9867: mol_type = other RNA
agcaccatgacactgctctgccttatccccactgccatggctttccacctgtccacgagagacggcgaacctttgatgattgtggcgaagcatgaaagggggcggccattactgtttaaaaccacagagggaataaacaagtgtactctaatcgccatggatctcggtgaaatgtgcgaggacaccgtcacatacaaatgtccgctgcttgttaataccgaacccgaggatattgactgctggtgtaacctgacttctacatgggtgatgtatggaacctgcacgcagtcaggggagcgccgacgtgaaaagagaagtgtagcgttgactcctcacagcggaatgggcctcgagaccagggctgaaacatggatgtcctctgagggtgcctggaaacatgcacagcgggtggagtcgtggatcctgcgcaatccagggttcgccctgctcgctggatttatggcatacatgattggccagactggcatccagagaaccgtcttctttgtgttaatgatgctggttgccccctcatatgggatgaggtgtgtgggagtcggtaaccgggatttcgtggaaggcgtaagcgggggagcttgggttgaccttgtgttggagcacggcggttgcgtcacaaccatggcccaggggaagcctacgctggattttgaactaactaagacaaccgcgaaagaggtggcactcctgcgcacttactgtatagaagcccttatcagtaatattacaaccgctacgcgatgcccaacccaaggagagccctatctgaaggaggaacaggaccagcagtacatctgtagaagggatgtggtcgaccggggctggggcaacgggtgcggattgttcggtaaaggcggggttgtgacatgcgccaagttttcctgttctggaaaaattactggcaatctcgtacaaatcgagaacctggaatataccgtggtcgtgacagttcataatggtgatactcacgcagtggggaacgacaccagcaatcacggcgtcacagctaccataactcctcgttccccatcagtggaggtaaagttaccggattacggagaactgacgctcgactgcgagccccgcagtggcattgacttcaacgagatgatccttatgaagatgaaaaagaaaacatggctggttcataagcagtggtttttggatctacctctgccatggaccgccggggcggacactagcgaagtgcactggaattacaaagagagaatggtcaccttcaaggtgccccatgccaaaaggcaggatgtcacagtgctcggatctcaggaaggtgcaatgcactccgctctggccggcgctaccgaggttgactcaggggatggaaaccacatgtttgccggccatcttaagtgtaaggtgcggatggaaaaactgcgaattaagggtatgagctatactatgtgcagtgggaaattctctatcgacaaggagatggcagagacacaacacggcacgaccgtagtcaaagtgaagtacgaaggagccggcgctccttgtaaggttccaatcgagattcgcgatgtgaataaagaaaaggtcgtggggagagtaatatccagcactcccttggcggagaacacaaactcggtgaccaatatcgagctcgaaccgcctttcggagactcttatattgttatcggtgtcggcaactccgcactgacattacattggtttaggaaagggtcaagtataggaaagatgttcgagagcacttaccggggcgccaaacgcatggctattctgggtgaaaccgcctgggattttgggtccgtgggcggactattcacgtctctcggcaaggcagtgcaccaggtctttgggagcgtttataccacaatgttcggaggcgtgtcatggatgatcagaatcctgattggttttcttgtgttgtggatcgggactaatagtaggaacacctccatggccatgacatgcattgctgtaggaggcataactctgttcctcggttttaccgtccaggccgacatgggctgtgtggttagctggtctgggcgtgagctgaagtgcggatcaggcatcttcgtggtcgataatgtgcatacgtggacagaacaatacaaatttcagcccgagagtccagcacggcttgcgagcgctattctgaacgcccacaaggacggggtttgtggaatccgatccaccactagattggagaatgtgatgtggaaacagatcacaaacgaactcaattatgtactgtgggagggcggtcacgacttaaccgtcgtggcaggggatgtgaagggagtcctgactaaaggcaagagggccctaacccctcccgtttctgacctcaagtactcgtggaaaacatggggtaaggctaaaattttcacgccagaagcccgcaacagcacctttctgatagatggccccgacacttccgagtgccctaatgaacggagagcatggaactcacttgaggtggaggattacgggttcggaatgttcacaaccaatatctggatgaagtttagggaaggcagttctgaggtatgtgaccatcgcttgatgagcgctgccattaaagatcagaaggcggtgcacgccgacatggggtattggatcgaatccagcaagaaccaaacatggcagattgagcgagctagcctgatcgaagtcaagacttgcctctggccaaagacccatacgctgtggtctaatggagtgttagagtcccagatgctgataccgaaaagttacgcaggccccttcagccagcacaactatcggcaaggttacgccacacagaccgttgggccttggcaccttggaaagttggagatcgattttggcgaatgcccaggtactaccgtgacaattcaggaggactgtgatcatcgtggcccctctctcagaactaccacagcttccgggaaactggtcacgcagtggtgctgtaggtcatgcaccatgcctccactacgcttcctgggagaagacggctgttggtatgggatggagatccggcccctcagtgagaaggaagagaacatggtgaaaagccaagttactgccggacagggcacatcggaaaccttttccatgggtctgctttgcttgactctgttcgtggaggaatgtttaagaaggcgagtcacacgcaagcacatgattctcgcagtagtgatcaccctgtgcgcgataattcttgggggactgacgtggatggatttgctccgggccctgatcatgctaggcgacactatgtctggcagaattgggggacagacccatctggctatcatggccgtttttaagatgagcccgggttacgtgctcggcgtcttcctgaggaaacttacatcacgtgagaccgcattgatggtgatagggatggctatgactacaaccctgagtatccctcacgacttaatggagctcattgatggaatctccctgggccttattctgctaaagatcgtaacacagtttgacaatactcaagtgggtaccctcgccctgtctttgacgttcatacgcagcacaatgtccctggtcatggcatggcggaccattatggccgttttatttgtggtgactctcatcccactgtgtagaacctcatgccttcagaaacagagccattgggtcgaaatcacagctctgattttgggggcgcaagccctccccgtgtatctgatgactctaatgaagggagcaagtaggcgatcttggcctctgaacgagggcatcatggctgttggccttgtatccctcctggggagcgccttgctgaaaaatgatgtgcccttagccggaccaatggtcgctggtggcctcctgcttgcagcctacgtgatgtcggggtcatctgcggacctgagtttggaaaaggctgccaacgttcagtgggatgagatggcagacattaccggatccagccctataatcgaagtgaagcaggatgaggacggctctttcagcattcgggatgtcgaggaaacgaatatgatcacactcctggtgaaactagccctgattaccgtatccggtctttaccccctcgctatcccagtcactatgacactgtggtatatgtggcaagtgaagacccaacgctcaggggcattgtgggacgttccgagtcctgccgcgactcagaaagctgccttaagcgagggagtgtacagaataatgcagaggggcctgtttggcaagacacaggtcggggtgggaatccacatggaaggtgttttccacaccatgtggcatgtgacgcggggctctgtcatttgtcacgagactgggcgactcgaaccctcctgggcagatgtgagaaacgacatgatctcatatggaggcggttggcgcctgggggataaatgggacaaggaggaggacgtacaagtgcttgccattgaaccaggaaagaatcccaaacatgttcagaccaagcctggcctgttcaaaacattggctggcgagatcggggccgtcaccctagattttaagccaggaacaagtggtagccccataattaacaggaaaggcaaggtgatcgggctgtacggaaatggcgtggtcactaaatccggtgactatgtatctgcaatcacccaggctgaacgtattggggagcctgattacgaggtggacgaagatatattccggaagaagagactcacgatcatggacctgcacccgggagccggcaaaacaaagaggattcttccatcgatcgttcgcgaggcgttaaaacgaagactgcggactctcattttggcccccaccagggtggtcgcagctgaaatggaggaagccctgcgcggcctccctatccgttatcagacaccagctgtgaagtcagagcataccgggagagagatagttgatctgatgtgccacgcaacttttaccacacggcttctgtcatccacgagggtgcccaactacaatttgatcgtcatggacgaagcccacttcactgatcctagttctgtggccgctcgcggatacattagcacccgagtagagatgggtgaagcggcagccatctttatgacagctaccccgcccggcgccactgacccattccctcaatccaactcacccattgaggatatcgaaagagagataccagagcggtcttggaatacagggtttgactggattaccgactatcagggaaaaacggtgtggttcgttcctagcatcaaggcaggcaacgatatcgccaattgcctaaggaagagtggtaaaaaggtcattcagctgtcccgcaaaacttttgacacagaataccccaagaccaaactcaccgattgggacttcgtggtgactacagatatcagcgagatgggggctaactttagagcgggcagggtcatagacccacggcgttgtttaaagccggttattctgaccgatggacctgaacgcgtgatccttgccggccccattccagtaacacccgcatctgctgcccaacgaagagggaggatcggacggaaccctgcacaggaggacgatcagtatgtgttctcaggtgacccactgaagaatgatgaagaccatgcccactggactgaggctaaaatgctcttggataacatatacacgcccgagggcattatccctaccctgttcgggccggaacgcgagaagacacaggccatcgacggagaatttagactcaggggcgagcaacggaaaactttcgtcgagctgatgcgaagaggtgaccttccagtgtggctatcctataaggttgcgagtgcagggattagctacaaagatcgcgaatggtgctttaccggcgagaggaataaccagatcctggaagagaatatggaagtggagatttggacacgggagggagaaaagaagaaattgcgtcccagatggttagacgccagggtctatgctgatcctatggccctgaaggacttcaaagagtttgcttcgggccgcaagtctataaccctcgatatcctgactgaaattgcatcccttcccacgtacctgagctcacgggccaaactcgctttggacaacatcgtaatgctgcataccacagagcgagggggcagagcctaccagcacgcactaaatgaactgccagagagtctcgagactcttatgctggtggcgttattgggtgccatgaccgctggcatcttcctgtttttcatgcaggggaagggaattggcaagctctctatgggtctgataacaatcgccgttgcatccgggcttctgtgggtggctgaaattcaacctcagtggatcgccgcaagcattatcctcgagtttttcttgatggtcctgttaatacccgaaccagagaaacagaggacccctcaggataaccaactaatctatgtgattctgactatcctcacaattatcggccttatagccgctaatgaaatgggactgattgagaagacgaaaaccgactttggcttctaccaggtcaagactgagacaaccatcttggatgtggacctgcgcccggcgtcagcctggaccctctatgcagttgctacaactattctgacgcccatgcttcggcacaccatcgaaaacacaagtgccaatctcagcctggccgcaatagctaaccaggccgcggtgttgatggggctgggaaaaggctggccattacatagaatggatctaggtgtacctctgctcgctatggggtgttactcccaggtgaatcccactacccttacagcctctctggtcatgttgctggttcactatgcaatcattggaccaggcctccaagccaaggctacccgtgaggcacagaaaaggactgccgcgggtatcatgaagaaccctacggtggacggcattacagtcatcgatctggaacccataagctacgacccgaagtttgagaaacagcttgggcaagtgatgttactggtactctgcgctggacagttgctgctaatgcggaccacttgggccttctgtgaggtgctgaccctcgcaacaggcccaattcttactctgtgggaagggaatcctggacgcttctggaacaccacaatcgccgtttccacggctaacatctttcgaggctcatatttggccggtgcagggctggctttctctctcattaagaatgcccagacccccagaaggggaactggcacaaccggtgagactctgggcgaaaaatggaagcggcagttaaacagtcttgaccgcaaagagtttgaagagtacaagagatcggggatcctggaggtggataggacagaagcaaagagcgccctcaaagacggatccaagataaaacatgcagtctctcgaggctcaagcaagattcggtggatcgtggagcgtgggatggtcaaaccaaagggaaagattgtggatctaggctgcggtagagggggatggtcctactatatggctaccctgaaaaatgttacggaagtaaagggctacaccaaaggcgggcccggacacgaggaacctatcccgatggccacatatggttggaacttggtgaagctgcatagtggcgtcgacgtgttctacaaacccactgagcaagttgataccctcctttgtgacataggggagtctagctcaaatccaacaatcgaagagggacgcactctgagggtgttgaagatggtcgaaccttggctgtccagtaagcccgagttttgcattaaagtgctcaacccttatatgccaaccgtaatcgaagagttagagaagctgcagcggaaacacggcggtaatcttgtgagatgtcccctgagccgcaactctacacacgaaatgtactgggtttccggggcatcaggaaatattgtcagctcggtgaacaccacttctaagatgctactcaataggttcacgacacgacatcggaaacctacctatgagaaggatgtggacctgggcgctggcactagaagtgtctccaccgaaacagagaaaccagatatgacgatcattgggaggcgcttgcagcgtctgcaggaggaacacaaggagacctggcattacgaccaagaaaacccctaccggacttgggcctatcacggaagctacgaggccccgtcaacaggttccgcgtctagcatggttaatggcgtggtaaagctccttaccaaaccttgggatgtgatcccaatggtcactcagctggctatgacagacaccacaccctttgggcagcagagagtgttcaaggaaaaagttgacactaggacccctcaaccaaagcccggaacgcgcatggtgatgaccacaactgcaaactggttatgggccctgttgggcaaaaagaagaatccgcgactctgcacccgggaggagtttataagtaaagtcagatccaacgctgccattggtgcagtgttccaggaagaacaggggtggacaagcgcctctgaagctgtaaatgattcaaggttttgggagctggttgacaaggaacgcgcgctacaccaagagggaaaatgtgagagttgcgtgtataacatgatgggcaagagagagaagaaacttggcgagttcgggcgggccaaaggatccagggcaatctggtacatgtggctgggtgctcgttttctcgagttcgaggccctgggcttcttgaacgaagatcattggtttgggcgagagaatagctggtctggagtcgagggcgaaggtctgcaccgcctcgggtatatccttgaggaaattgacaaaaaggatggagacctgatgtacgcagatgacactgccggctgggataccagaataacggaggacgatttacagaacgaggaactgatcacagagcagatggctcctcatcacaaaattttggccaaggcgatcttcaaactcacctatcagaataaggtggtgaaggtcctgcggcccactccaaggggcgcagttatggacattatctcgcgcaaagatcaaagagggtcaggacaggtgggtacatacggcctaaacacctttactaatatggaagtacagcttatacggcagatggaggccgaaggggtgatcacccaagacgacatgcagaaccctaagggactgaaagagagggtcgagaagtggctccgagaatgcggcgtggatcgtctgaaaagaatggctattagcggtgacgattgtgttgtgaagcccttggacgagcgcttcgggacatccttactgtttctcaatgatatgggaaaagtccggaaggacatcccacagtgggaacccagtaagggctggaaaaactggcaggaggtgcctttctgctctcatcactttcacaagattttcatgaaagatggcaggagccttgtagttccatgtagaaatcaagacgaactgatcgggcgcgcccggatatcccagggagcaggttggtcactaagggagacggcttgcctgggcaaggcctacgctcagatgtggagtctcatgtattttcatcgaagagatttgcggctggcctctatggcaatttgtagcgcggtgccgaccgagtggcttcccacttccaggacaacctggtcaatccacgcccatcaccagtggatgactacagaagacatgctgaaagtctggaaccgcgtgtggatcgaggataatcctaacatgattgacaagaccccagttcacagctgggaagacataccctacctcgggaagcgtgaggatttatggtgcggatctctgatcggcttgtccagtagagctacgtgggccaaaaatattcatacagcaatcacccaagtgcgaaacctgattggtaaggaagagtatgtcgactacatgcctgtgatgaaaaggtatagcgctccatcggagtccgaaggggtactctga

SEQ ID NO: 15731 - RNA, 9867 nt, synthetic construct
  misc_feature 1..9867: note = derived and/or modified CDS sequence (opt3) from DENV-4__JN819409__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgactgccacatgggtaatgtatggcacctgcacgcagtctggggagcgccgacgtgaaaagagatcagtggcgttgactcctcacagtggaatgggcctcgagaccagggctgaaacatggatgagctccgagggtgcctggaaacatgcacaacgggtcgagtcttggattctgcgcaatccagggttcgccctgctcgctggatttatggcatacatgatcggccagactggcatacagagaaccgtgttctttgttttaatgatgctggtggccccctcgtatgggatgaggtgtgtcggagtgggtaaccgggatttcgtagaaggcgtttcagggggagcttgggtggaccttgtcttggagcacggcggttgcgtgacaaccatggcccaggggaagcctacgctggattttgaactaactaagacaaccgcgaaagaggtggcactcctgcgcacttactgtatcgaagcccttattagcaatatcacaaccgctacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgccaagtttagttgttccggaaaaatcactggcaatctcgtgcaaatagagaacctggaatataccgtcgtggttacagtgcataatggtgatactcacgcagtcgggaacgacacctctaatcacggcgtgacagctaccattactcctcgtagcccatccgtagaggttaagttaccggattacggagaactgacgctcgactgcgagccccgctcaggcatcgacttcaacgagatgattcttatgaagatgaaaaagaaaacatggctggtgcataagcagtggtttttggatctacctctgccatggaccgccggggcggacactagtgaagtccactggaattacaaagagagaatggtgaccttcaaggtcccccatgccaaaaggcaggatgtgacagttctcggaagccaggaaggtgcaatgcactctgctctggccggcgctaccgaggtggactccggggatggaaaccacatgtttgccggccatcttaagtgtaaggtacggatggaaaaactgcgaatcaagggtatgtcatatactatgtgcagcgggaaattcagtatcgacaaggagatggcagagacacaacacggcacgaccgtcgtgaaagttaagtacgaaggagccggcgctccttgtaaggtgccaattgagatacgcgatgtcaataaagaaaaggtggtagggagagtgatctcttccactcccttggcggagaacacaaacggagttaccaatattgagctcgaaccgcctttcggtgacagctatatcgtcataggcgtggggaactcggcactgacattacattggtttaggaaaggatcttccattggcaagatgttcgagtcaacttaccggggtgccaaacgcatggctatcctgggggaaaccgcctgggattttggcagtgtgggaggcctattcacgagcctcgggaaggcagtccaccaggtttttggatccgtgtataccacaatgttcggcggtgtgtcttggatgatcagaattctgatcgggtttcttgtattgtggattggaactaatagcaggaacacctcaatggccatgacatgcatagctgtcggcggtatcactctgttcctcggctttaccgtgcaggccgacatggggtgtgttgtgagttggtccggacgtgagctgaagtgcggcagcgggattttcgtcgtggataatgttcatacgtggacagaacaatacaaatttcagcccgagtctccagcacggcttgcgtcagctatcctgaacgcccacaaggacggagtgtgtggcatccgaagtaccactagattggagaatgtaatgtggaaacagattacaaacgaactcaattatgtcctgtgggagggtgggcacgacttaaccgtggtggcaggagatgtcaagggcgttctgactaaaggtaagagggccctaacccctcccgtgagcgacctcaagtactcctggaaaacatggggcaaggctaaaatattcacgccagaagcccgcaactctacctttctgatcgatgggcccgacacttcggagtgccctaatgaacggagagcatggaacagccttgaggtagaggattacggattcggcatgttcacaaccaatatttggatgaagtttagggaagggtcctcagaggtgtgtgaccatcgcttgatgagtgctgccatcaaagatcagaaggcggtccacgccgacatgggatattggattgaatctagcaaaaaccaaacatggcagatcgagcgagcttccctgatagaagtgaagacttgcctctggccaaagacccatacgctgtggtcaaatggcgttttagagagccagatgctgatcccgaaatcttacgcaggtcccttctcccagcacaactatcggcaagggtacgccacacagaccgtgggaccttggcaccttggcaagttggagattgattttggtgaatgcccaggcactaccgtcacaatccaggaggactgtgatcatcgtgggcccagtctcagaactaccacagctagcggaaaactggtgacgcagtggtgctgtaggtcttgcaccatgcctccactacgcttcctgggcgaagacgggtgttggtatggaatggagattcggcccctctccgagaaggaagagaacatggttaaatcacaagtgactgccggccagggtacaagtgaaacctttagcatggggctgctttgcttgactctgttcgtcgaggaatgtttaagaaggcgagtaacacgcaagcacatgatcctcgcagtgataattaccctgtgcgcgatcattcttggaggcctgacgtggatggatttgctccgggccctgatcatgctaggcgacactatgtcggggagaataggaggtcagacccatctggctatcatggccgtttttaagatgtccccgggctacgtgctcggggtcttcctgaggaaacttacatctcgtgagaccgcattgatggtgattggaatggctatgactacaaccctgagcatccctcacgacttaatggagctcattgatggcatctcactgggtcttatactgctaaagattgtaacacagtttgacaatactcaagtggggaccctcgccctgagtttgacgttcatccgctccacaatgtctctggtcatggcatggcggaccatcatggccgttttatttgtggtgactctcattccactgtgtagaaccagctgccttcagaaacagtcccattgggtcgaaatcacagctctgattttgggagcgcaagccctccccgtgtatctgatgactctaatgaagggcgcatcaaggcgaagctggcctctgaacgagggcataatggctgttgggcttgtaagtctcctgggatctgccttgctgaaaaatgatgtgcccttagccggtccaatggtcgctggcgggctcctgcttgcagcctacgtgatgtccggaagctcggcggacctgtcattggaaaaggctgccaacgttcagtgggatgagatggcagacatcaccggctctagtcctattatcgaagtgaagcaggatgaggacggttccttcagcattcgggatgtcgaggaaacgaatatgatcacactcctggtgaaactagccctgataaccgtatctgggctttaccccctcgctatcccagtcactatgacactgtggtatatgtggcaggtgaagacccaacgcagcggagcattgtgggacgttccgtcccctgccgcgactcagaaagctgccttatcagagggcgtgtacagaattatgcagaggggcctgtttgggaagacacaggtcggagtgggtatccacatggaaggcgttttccacaccatgtggcatgtgacgcgggggagtgtcatttgtcacgagactggacgactcgaacccagctgggcagatgtgagaaacgacatgatctcttatggcggtgggtggcgcctgggagataaatgggacaaggaggaggacgtacaagtgcttgccatagaaccaggcaagaatcccaaacatgttcagaccaagcctggcctgttcaaaacattgaccggggagattggagctgtcacactagattttaagccaggtacttccggctcacccatcatcaacaggaaagggaaggtgattggactgtacggcaatggtgtggtcaccaaaagtggggactatgtaagcgccataacgcaggcagaacgtatcggagagcctgattacgaggtggacgaagatattttccggaagaagagactcacaatcatggacctgcacccgggcgctggcaaaactaagaggattcttccatccatcgttcgcgaggccttaaaacgaagactgcggaccctcatattggcgcccacaagggtggtcgccgcagaaatggaggaagctctgcgcgggctccctatccgttatcagaccccagccgtgaagtctgagcatactggaagagagattgttgatctgatgtgccacgctacctttacaacgcggcttctgtcgagcactagggtgcccaactacaatttgatcgtcatggacgaagcacacttcaccgatccttcatccgtggccgcccgcggttacattagtacacgagtagagatgggcgaagctgcggcaatctttatgaccgccactccgcccggggctacagacccattccctcaatctaacagccccatagaggatattgaaagagagatcccagagcggtcctggaataccggatttgactggatcacggactatcagggcaaaactgtgtggttcgttccttcaattaaggccggtaacgatatcgcaaattgcctaaggaagtctgggaaaaaggtcatacagctgagccgcaaaacatttgacaccgaataccccaagaccaaactcactgattgggacttcgtggtgacaaccgatattagtgagatgggcgccaactttagagctggaagggtcatcgacccacggcgttgtttaaagccggttattctgacagatggccctgaacgcgtgatccttgcggggcccataccagtaactcccgcctccgcagctcaacgaagaggaaggattggtcggaaccctgcccaggaggacgatcagtatgtgttcagcggcgacccactgaagaatgatgaagaccatgcacactggacggaggccaaaatgctcttggataacatctacacccccgaggggatcattcctacactgttcggaccggaacgcgagaagactcaggctatcgacggcgaatttagactcaggggtgagcaacggaaaaccttcgtcgagctgatgcgaagaggggaccttccagtgtggctatcttataaggttgcctcagcgggcatttcctacaaagatcgcgaatggtgctttacaggagagaggaataaccagatactggaagagaatatggaagtggagatctggacccgggagggcgaaaagaagaaattgcgtcccagatggttagacgcaagggtctatgccgatcctatggctctgaaggacttcaaagagtttgccagtgggcgcaagagcattactctcgatatcctgacggaaatcgcttcgcttcccacctacctgtcttcccgggcaaaactcgccttggacaacattgtaatgctgcatacaactgagcgaggaggtagagcttaccagcacgccctaaatgaactgccagagagcctcgagacccttatgctggtggcattattgggcgcgatgacagccgggatattcctgtttttcatgcagggaaagggcatcggtaagctctcaatggggctgattaccatcgctgttgccagtggccttctgtgggtggcagaaattcaacctcagtggatcgctgcctctataatcctcgagtttttcttgatggtcctgttaattcccgaaccagagaaacagaggactcctcaggataaccaactaatctatgtgattctgacaatcctcacgataattggacttatcgcagccaatgaaatgggcctgattgagaagaccaaaactgactttgggttctaccaggtcaagacagagaccaccatcttggatgtggacctgcgcccggcttccgcgtggacactctatgccgttgcaactacgatactgacccccatgcttcggcacacaatcgaaaacactagcgctaatctctcactggccgccattgcaaaccaggctgccgtgttgatgggactgggcaaaggttggccattacatagaatggatctaggggtacctctgctcgcgatgggatgttacagtcaggtgaatcccaccacacttaccgctagcctggtcatgttgctggttcactatgccatcattggcccaggtctccaagcaaaggccactcgtgaggctcagaaaaggacggcagccggcatcatgaagaaccctacagtggacgggataaccgtcattgatctggaacccatctcctacgacccgaagtttgagaaacagcttggacaagtgatgttactggtactctgcgcgggccagttgctgctaatgcggactacctgggctttctgtgaggtgctgacactcgccactgggccaatccttaccctgtgggaaggaaatcctggccgcttctggaacacaacgattgcagtttctaccgccaacatctttcgaggtagctatttggctggggccggactggcattctccctcataaagaatgctcagactcccagaaggggcacaggtaccactggcgagacactgggggaaaaatggaagcggcagttaaactcacttgaccgcaaagagtttgaagagtacaagagatctggaattctggaggtggataggaccgaagccaagagtgcgctcaaagacggctcgaagatcaaacatgccgtcagccgagggtcctctaagattcggtggatcgtggagcgtggaatggtcaaaccaaagggcaaggtggttgatctaggttgcgggagaggaggctggtcatactatatggcaacgctgaaaaatgtaaccgaagtgaagggctacacaaaagggggacccggtcacgaggaacctataccgatggctacttatggctggaacttggtcaagctgcatagcggggtggacgttttctacaaacccaccgagcaagtggatacactcctttgtgacatcggagagtccagttctaatccaactattgaagagggccgcaccctgagggtcttgaagatggtggaaccttggctgagctcaaagcccgagttttgcatcaaagtactcaacccttatatgccaacagtgattgaagagttagagaagctgcagcggaaacacggtgggaatcttgttagatgtcccctgtcccgcaacagtacccacgaaatgtactgggtcagcggagcctctggcaatatcgtgtcctcagtgaacactacgagcaagatgctactcaataggttcacaacccgacatcggaaacctacttatgagaaggatgtcgacctgggcgcagggaccagatcggtttctacagaaacggagaaaccagatatgaccattatcggaaggcgcttgcagcgtctgcaggaggaacacaaggagacttggcattacgaccaagaaaacccctaccggacatgggcttatcacggtagttacgaggccccgtccaccggcagcgcctcatccatggtgaatggggtagtgaagctccttactaaaccttgggatgtcataccaatggtgacacagctggcgatgaccgacacaactccctttggacagcagagagttttcaaggaaaaagtggacaccaggacgcctcaaccaaagcccggcacccgcatggtcatgacaactaccgctaactggttatgggcactgttgggtaaaaagaagaatccgcgactctgcacaaaagaggagtttatttctaaggtgcggagcaacgccgctatcggggccgtattccaggaagagcagggatggactagtgcatccgaagccgttaatgatagcagattttgggagctggtggacaaagaaagggctctacaccaagagggcaagtgtgagtcttgcgtctataacatgatgggcaaacgcgaaaagaagcttggggagttcggaagagcgaaaggttcacgggccatctggtacatgtggctgggcgcaaggtttctcgaattcgaggctctggggttcttgaacgaagatcattggtttggacgtgagaatagttggtccggcgtggagggtgaagggctgcaccgactcggatatattcttgaggaaatagacaagaaagatggcgacctgatgtacgccgatgacaccgcaggctgggatacgcgcatcacagaggacgatttacagaacgaggaactgattaccgagcagatggcccctcatcacaagatcttggctaaagccattttcaagctcacttatcagaataaggtggtcaaagttctgagacccacaccacggggggcggtgatggacatcataagcaggaaggatcaacgcggatctggtcaggtaggcacctacgggctaaacacttttaccaatatggaagtgcagcttatcagacagatggaggcagaaggagtcattacacaagacgacatgcagaaccctaaaggcctgaaggagcgggtggagaaatggctcagggaatgcggtgttgatcgactgaagcgtatggccatctcgggggacgattgtgtggtcaaacccttggacgagagattcggaacgtcattactgtttctcaatgatatgggcaaggtgcgcaaggacattccacagtgggaacccagcaaaggctggaagaactggcaggaggtacctttctgctcccatcactttcacaaaatcttcatgaaggatgggcggagtcttgttgtgccatgtaggaatcaagacgaactgataggaagagctcgcatttctcagggtgccggctggagcctacgggagaccgcatgcctggggaaagcttacgcccagatgtggtccctcatgtattttcataggcgagatttgagactggcttcaatggccatctgtagtgcagtcccgactgagtggttccccacatctcggaccacttggagcatccacgcgcatcaccagtggatgacaaccgaagacatgcttaaggtgtggaacagggtttggattgaggataatcctaacatgacggacaagacaccaatacactcctgggaagacatcccctacctgggaaaacgcgaggatctctggtgcggctcattaattggtctgagctctcgtgccacctgggctaagaatatccatactgccattacccaagtgagaaacttgatcgggaaagaagagtatgtcgactacatgcctgtgatgaagcgatattccgcaccaagtgagagcgaaggagtactgtga

SEQ ID NO: 15732 - RNA, 9867 nt, synthetic construct
  misc_feature 1..9867: note = derived and/or modified CDS sequence (opt3) from DENV-4__FJ639742__SS-prME
  source 1..9867: mol_type = other RNA
tcaaccatgacactgctctgccttatccccactgccatggctttccacctgtccacgagagacggagaacctttgatgattgtggcaaagcatgaaagggggcggccattactgtttaaaaccacagagggaataaacaagtgtactctaatcgccatggatctcggtgaaatgtgcgaggacaccgtcacatacaaatgtccgctgcttgttaataccgaacccgaggatattgactgctggtgtaacctgacttctacatgggtgatgtatggaacctgcacgcagtcaggggagcgccgacgtgaaaagagaagtgtagcgttgactcctcacagcggaatgggcctcgagaccagggctgaaacatggatgtcctctgagggtgcctggaaacatgcacaacgggtggagtcgtggatcctgcgcaatccagggttcgccctgctcgctggatttatggcatacatggtcggccagactggcattcagagaaccgtgttctttgttttaatgatgctggtggccccctcatatgggatgaggtgtgtcggagtgggtaaccgggatttcgtagaaggcgttagcgggggagcttgggtggaccttgtcttggagcacggcggttgcgtgacaaccatggcccaggggaagcctacgctggattttgaactaactaagacaaccgcgaaagaggtggcactcctgcgcacttactgtatcgaagcccttataagtaatatcacaaccgctacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgccaagttttcctgttctggaaaaatcactggcaatctcgtgcaaattgagaacctggaatataccgtcgtggttacagtgcataatggtgatactcacgcagtcgggaacgacaccagcaatcacggcgtgacagctaccatcactcctcgttccccatcagtagaggttaagttaccggattacggagaactgacgctcgactgcgagccccgcagtggcatagacttcaacgagatgattcttatgaagatgaaaaagaaaacatggctggtgcataagcagtggtttttggatctacctctgccatggaccgccggggcggacactagcgaagtccactggaattacaaagagagaatggtgaccttcaaggtcccccatgccaaaaggcaggatgtgacagttctcggatctcaggaaggtgcaatgcactccgctctggccggcgctaccgaggtggactcaggggatggaaaccacatgtttgccggccatcttaagtgtaaggtacggatggaaaaactgcgaatcaagggtatgagctatactatgtgcagtgggaaattctctattgacaaggagatggcagagacacaacacggcacgaccgtcgtgaaagttaagtacgaaggagccggcgctccttgtaaggtgccaatcgagatccgcgatgtcaataaagaaaaggtggtagggagagtgatttccagcactcccttggcggagaacacaaactcggttaccaatatagagctcgaaccgcctttcggagactcttatatcgtcattggtgtgggcaactccgcactgacattacattggtttaggaaagggtcaagtatcggaaagatgttcgagagcacttaccggggcgccaaacgcatggctatactgggtgaaaccgcctgggattttgggtccgtgggcggactattcacgtctctcggcaaggcagtccaccaggtttttgggagcgtgtataccacaatgttcggaggcgtgtcatggatgattagaatcctgatcggttttcttgtattgtggattgggactaatagtaggaacacctccatggccatgacatgcatcgctgtcggaggcattactctgttcctcggttttaccgtgcaggccgacatgggctgtgttgtgagctggtctgggcgtgagctgaagtgcggatcaggcatattcgtcgtggataatgttcatacgtggacagaacaatacaaatttcagcccgagagtccagcacggcttgcgagcgctatcctgaacgcccacaaggacggggtgtgtggcattcgatccaccactagattggagaatgtaatgtggaaacagatcacaaacgaactcaattatgtcctgtgggagggcggtcacgacttaaccgtggtggcaggggatgtcaagggagttctgactaaaggcaagagggccctaacccctcccgtgtctgacctcaagtactcgtggaaaacatggggtaaggctaaaatcttcacgccagaagcccgcaacagcacctttctgattgatggccccgacacttccgagtgccctaatgaacggagagcatggaactcacttgaggtagaggattacgggttcggaatgttcacaaccaatatatggatgaagtttagggaaggcagttctgaggtgtgtgaccatcgcttgatgagcgctgccatcaaagatcagaaggcggtccacgccgacatggggtattggattgaatccagcaagaaccaaacatggcagatcgagcgagctagcctgattgaagtgaagacttgcctctggccaaagacccatacgctgtggtctaatggagttttagagtcccagatgctgatcccgaaaagttacgcaggccccttcagccagcacaactatcggcaaggttacgccacacagaccgtggggccttggcaccttggaaagttggagatagattttggcgaatgcccaggtactaccgtcacaatccaggaggactgtgatcatcgtggcccctctctcagaactaccacagcttccgggaaactggtgacgcagtggtgctgtaggtcatgcaccatgcctccactacgcttcctgggagaagacggctgttggtatgggatggagattcggcccctcagtgagaaggaagagaacatggttaaaagccaagtgactgccggacagggcacatcggaaaccttttccatgggtctgctttgcttgactctgttcgtcgaggaatgtttaagaaggcgagtaacacgcaagcacatgatcctcgcagtggttattaccctgtgcgcgatcatacttgggggactgacgtggatggatttgctccgggccctgattatgctaggcgacactatgtctggcagaatcgggggacagacccatctggctattatggccgtgtttaagatgagcccgggttacgtcctcggcgtgttcctgaggaaacttacatcacgtgagaccgcattgatggtaatcgggatggctatgactacaaccctgagtatacctcacgacttaatggagctcatcgatggaatttccctgggccttatcctgctaaagattgtgacacagtttgacaatactcaagtcggtaccctcgccctgtctttgacgttcatccgcagcacaatgtccctggttatggcatggcggaccataatggccgtgttatttgtggtcactctcattccactgtgtagaacctcatgccttcagaaacagagccattgggtggaaatcacagctctgatcttgggggcgcaagccctccccgtttatctgatgactctaatgaagggagcaagtaggcgatcttggcctctgaacgagggcattatggctgtaggccttgtgtccctcctggggagcgccttgctgaaaaatgatgtccccttagccggaccaatggtggctggtggcctcctgcttgcagcctacgttatgtcggggtcatctgcggacctgagtttggaaaaggctgcctccgtgcagtgggatgagatggcagacatcaccggaagctctcctattatagaagtcaagcaggatgaggacggcagcttctccatccgggatgtggaggaaacgaacatgattacactcctggtaaaactagccctgatcaccgtctcaggtctttaccccctcgctattccagtgactatgacactgtggtatatgtggcaggttaagacccaacgcagtggggcattgtgggacgtgccgagccctgccgcgactcagaaagctgccttatctgagggagtctacagaatcatgcagaggggcctgtttggcaagacacaggtgggggttggaatacacatggaaggtgtgttccacaccatgtggcatgtcacgcggggctccgtgatctgtcacgagactgggcgactcgaaccctcatgggcagatgtaagaaatgacatgattagttatggaggcggttggcgcctgggggataaatgggacaaggaggaggacgtgcaagttcttgccatcgaaccaggaaagaaccccaaacatgtccagaccaagcctggcctgttcaaaacattgaccggcgagattggggctgtgacactagattttaagccaggaactagcggttcccccatcataaataggaaaggcaaggtgattgggctgtacggaaacggcgtcgtaaccaaatctggtgactatgtgtcggccatcacgcaggcagaacgtatcggggagcctgattacgaggttgacgaagatattttccggaagaagagactcacaataatggacctgcacccgggagctggcaaaactaagaggatccttccaagcattgtgcgcgaggccttaaaacgaagactgcggaccctcatcttggcgcccacaagggtcgtggccgcagaaatggaggaagctctgcgcggcctccctattcgttatcagaccccagccgttaagtcagagcatactgggagagagatcgtggatctgatgtgccacgctacctttacaacgcggcttctgtccagtactagggtccccaattacaacttgatagtgatggacgaagcacacttcaccgatccttctagcgtagccgcccgcggatacatctccacacgagtggagatgggtgaagctgcggcaatttttatgaccgccactccgcccggcgctacagacccattccctcaatcaaattctcccatcgaggatattgaaagagagatcccagagcggagctggaacaccgggtttgactggataacggactatcagggaaaaactgtttggttcgtccctagtattaaggccggcaatgatatcgcaaactgcctaaggaagtccggtaaaaaggtgatccagctgagccgcaaaacatttgacaccgaataccccaagaccaaactcactgattgggacttcgtggtcacaaccgatatttctgagatgggggccaattttagagctggcagggttatcgacccacggcgttgtttaaagccggtgatactgacagatggacctgaacgcgtaattcttgcgggccccatcccagtgactcccgcctcagcagctcaacgaagagggaggattggacggaaccctgcccaggaggacgatcagtatgtcttctccggtgacccactgaagaacgatgaagaccatgcacactggacggaggccaaaatgctcttggataatatctacacccccgagggcataattcctacactgttcgggccggaacgcgagaagactcaggctatcgacggagaatttagactcaggggcgagcaacggaaaaccttcgtggagctgatgcgaagaggtgaccttccagtttggctaagttataaggtggccagcgcggggatctcgtacaaagatcgcgaatggtgctttacaggcgagaggaacaatcagattctggaagagaacatggaagtcgagatctggacccgggagggagaaaagaagaaattgcgtcccagatggttagacgcaagggtatatgccgatcctatggctctgaaggacttcaaagagtttgcctctggccgcaagtccattactctcgatatactgacggaaatcgctagccttcccacctacctgtcaagtcgggcaaaactcgccttggacaatattgtgatgctgcatacaactgagcgagggggcagagcttaccagcacgccctaaacgaactgccagagtctctcgagacccttatgctggttgcattattgggtgcgatgacagccggcatcttcctgtttttcatgcaggggaagggaatcggcaagctctccatgggtctgattaccatagctgtggccagcgggcttctgtgggtcgcagaaatccaacctcagtggattgctgcctcaatcattctcgagtttttcttgatggtgctgttaatccccgaaccagagaaacagaggactcctcaggataatcaactaatatatgtcatcctgacaattctcacgatcattggccttatcgcagccaacgaaatgggactgatagagaagaccaaaactgactttggcttctaccaggtgaagacagagaccaccattttggatgttgacctgcgcccggctagtgcgtggacactctatgccgtggcaactacgatcctgacccccatgcttcggcacacaattgaaaatactagcgctaacctctccctggccgccatcgcaaatcaggctgccgtattgatggggctgggaaaaggctggccattacatagaatggatctaggtgtgcctctgctcgcgatggggtgttactctcaggtcaaccccaccacacttaccgctagcctggttatgttgctggtgcactatgccataatcggaccaggcctccaagcaaaggccactcgtgaggctcagaaaaggacggcagccggtattatgaagaatcctacagtcgacggcatcaccgtgattgatctggaacccatctcctacgacccgaagtttgagaaacagcttgggcaagtaatgttactggtgctctgcgcgggacagttgctgctaatgcggactacctgggctttctgtgaggttctgacactcgccactggcccaatacttaccctgtgggaagggaaccctggacgcttctggaatacaacgattgcagtgtcaaccgccaacatctttcgaggctcttatttggctggtgccgggctggcattcagtctcatcaagaacgctcagactcccagaaggggaacaggcaccactggtgagacactgggcgaaaaatggaagcggcagttaaattcgcttgaccgcaaagagtttgaagagtacaagagaagcgggattctggaggtcgataggaccgaagccaagtccgcgctcaaagacggatctaagatcaaacatgccgtgtcacgaggcagctccaagatacggtggattgtcgagcgtgggatggtgaaaccaaagggaaaggttgtagatctaggctgcggtagagggggatggagttactatatggcaacgctgaaaaacgtgaccgaagtcaagggctacacaaaaggcgggcccggacacgaggaacctatcccgatggctacttatggttggaatttggtgaagctgcattctggcgttgacgtgttctacaaacccaccgagcaagtcgatacactcctttgtgacattggggagagctcatccaacccaactatcgaagagggacgcaccctgagggtgttgaagatggtagaaccttggctgagtagcaagcccgagttttgcataaaagtgctcaatccttatatgccaacagttatcgaagagttagagaagctgcagcggaaacacggcggtaaccttgtcagatgtcccctgtctcgcaattccacccacgaaatgtactgggtgtcaggggccagcggaaacattgtgtcgtctgtcaatactacgagtaagatgctactcaacaggttcacaacccgacatcggaaacctacttatgagaaggatgttgacctgggcgcaggcaccagatccgtgagcacagaaacggagaaaccagatatgaccatcattgggaggcgcttgcagcgtctgcaggaggaacacaaggagacttggcattacgaccaagaaaatccctaccggacatgggcttatcacggatcatacgaggccccgtccaccggttctgccagcagtatggtaaacggcgtggtcaagctccttactaaaccttgggatgtgatcccaatggttacacagctggcgatgaccgacacaactccctttgggcagcagagagtgttcaaggaaaaagtcgacaccaggacgcctcaaccaaagcccggaacccgcatggtgatgacaactaccgctaattggttatgggcactgttgggcaaaaagaagaacccgcgactctgcacacgggaggagtttatttccaaagtaagaagcaatgccgctatcggtgccgttttccaggaagaacaggggtggacttctgcatcagaagccgtgaacgatagtaggttttgggagctggtcgacaaggaacgcgctctacaccaagagggaaaatgtgagtcctgcgtgtataatatgatgggcaagagagagaagaaacttggcgagttcgggcgggcgaaaggaagcagggccatatggtacatgtggctgggtgcacgttttctcgagttcgaggctctgggcttcttgaacgaagatcattggtttgggcgagagaactcttggtcgggagtggagggcgaaggtctgcaccgcctcgggtatattcttgaggaaatcgacaaaaaggatggagacctgatgtacgccgatgacaccgcaggctgggatacgagaatcacagaggacgatttacagaatgaggaactgattaccgagcagatggcccctcatcacaaaatattggctaaggccatcttcaaactcacttatcagaacaaggtcgttaaggtgctgcggcccacaccaaggggcgcggtaatggacattatctcacgcaaagatcaaagagggagcggacaggtgggtacctacggcctaaatacttttaccaacatggaagtccagcttattcggcagatggaggcagaaggggtgatcacacaagacgacatgcagaatcctaagggactgaaagagagggttgagaagtggctccgagaatgcggcgtggatcgtctgaaaagaatggccatatccggtgacgattgtgtcgtgaagcccttggacgagcgcttcgggacgagtttactgtttctcaacgatatgggaaaagtacggaaggacatcccacagtgggaaccctctaagggctggaaaaattggcaggaggttcctttctgcagccatcactttcacaagattttcatgaaagatggcaggtcccttgtggtcccatgtagaaaccaagacgaactgatcgggcgcgctcggatttcacagggagccggttggagtctaagggagaccgcatgcctgggcaaggcttacgcccagatgtggtctctcatgtattttcatcgaagagatttgcggctggctagcatggccatctgttccgcagtgccgactgagtggttccccacatcaaggaccacttggagcatacacgcgcatcaccagtggatgacaaccgaagacatgcttaaagtttggaatcgcgtgtggattgaggataaccctaatatgatcgacaagacgccagtccactcttgggaagacatcccctacctggggaagcgtgaggatctctggtgcggatccttaattggcctgagtagcagagccacatgggctaaaaacatacataccgccatcactcaagtgcgaaatttgattggtaaggaagagtatgtagactacatgcctgtgatgaaaaggtattcggcaccatccgagtctgaaggggtcctgtga

SEQ ID NO: 15733 - RNA, 9867 nt, synthetic construct
  misc_feature 1..9867: note = derived and/or modified CDS sequence (opt3) from DENV-4__FJ639745__SS-prME
  source 1..9867: mol_type = other RNA
agcaccatgacactgctctgccttatccccactgccatggctttccacctgtccacgagagacggcgagcctttgatgattgtggcaaagcatgaaagggggcggccattactgtttaaaaccacagagggaataaacaagtgtactctaatcgccatggatctcggtgaaatgtgcgaggacaccgtcacatacaaatgtccgctgcttgttaataccgaacccgaggatattgactgctggtgtaacctgacttctacatgggtgatgtatggcacctgcacgcagtcaggggagcgccgacgtgaaaagagaagtgtagcgttgactcctcacagcggaatgggcctcgagaccagggctgaaacatggatgtcctctgagggtgcctggaaacatgcacaacgggtggagtcgtggatcctgcgcaatccagggttcgccctgctcgctggatttatggcatacatgattggccagactggcatccagagaaccgtcttctttgtgttaatgatgctggttgccccctcatatgggatgaggtgtgtgggagtcggtaaccgggatttcgtggaaggcgtaagcgggggagcttgggttgaccttgtgttggagcacggcggttgcgtcacaaccatggcccaggggaagcctacgctggattttgaactaactaagacaaccgcgaaagaggtggcactcctgcgcacttactgtatagaagcccttatcagtaatattacaaccgctacgcgatgcccaacccaaggagagccctatctgaaggaggaacaggaccagcagtacatctgtagaagggatgtggtcgaccggggctggggcaacgggtgcggattgttcggtaaaggcggggttgtgacatgcgccaagttttcctgttctggaaaaattactggcaatctcgtacaaatcgagaacctggaatataccgtggtcgtgacagttcataatggtgatactcacgcagtggggaacgacaccagcaatcacggcgtcacagctaccataactcctcgttccccatcagtggaggtaaagttaccggattacggagaactgacgctcgactgcgagccccgcagtggcattgacttcaacgagatgatccttatgaagatgaaaaagaaaacatggctggttcataagcagtggtttttggatctacctctgccatggaccgccggggcggacactagcgaagtgcactggaattacaaagagagaatggtcaccttcaaggtgccccatgccaaaaggcaggatgtcacagtgctcggatctcaggaaggtgcaatgcactccgctctggccggcgctaccgaggttgactcaggggatggaaaccacatgtttgccggccatcttaagtgtaaggtgcggatggaaaaactgcgaattaagggtatgagctatactatgtgcagtgggaaattctctatcgacaaggagatggcagagacacaacacggcacgaccgtagtcaaagtgaagtacgaaggagccggcgctccttgtaaggttccaatcgagattcgcgatgtgaataaagaaaaggtcgtggggagagtaatatccagcactcccttggcggagaacacaaactcggtgaccaatatcgagctcgaaccgcctttcggagactcttatattgttatcggtgtcggcaactccgcactgacattacattggtttaggaaagggtcaagtataggaaagatgttcgagagcacttaccggggcgccaaacgcatggctattctgggtgaaaccgcctgggattttgggtccgtgggcggactattcacgtctctcggcaaggcagtgcaccaggtctttgggagcgtttataccacaatgttcggaggcgtgtcatggatgatcagaatcctgattggtcttttggtgctgtggatcgggactaatagtaggaacacctccatggccatgacatgcattgctgtaggaggcataactctctttctgggtttcaccgtccaggccgacatgggctgtgtggttagctggtctgggcgtgagcttaagtgcggatcaggcatctttgtggtcgataatgtgcatacgtggacagaacaatacaaattccagcccgagagtccagcacggctggcgagcgctattttgaacgcccacaaggacggggtttgtggaatccgatccaccactagactcgagaatgtgatgtggaaacagatcacaaacgaactgaattatgtattatgggagggcggtcacgacctgaccgtcgtggcaggggatgtgaagggagtcctaactaaaggcaagagggccctcacccctcccgtttctgacctgaagtactcgtggaaaacatggggtaaggctaaaatttttacgccagaagcccgcaacagcaccttccttatagatggccccgacacttccgagtgccctaatgaacggagagcatggaactcattggaggtggaggattacgggtttggaatgttcacaaccaatatctggatgaagttcagggaaggcagttctgaggtatgtgaccatcgcctgatgagcgctgccattaaagatcagaaggcggtgcacgccgacatggggtattggatcgaatcctcaaaaaaccaaacatggcagattgagcgagctagcctcatcgaagtcaagacttgcctgtggccaaagacccatacgttatggtctaatggagtgctggagtcccagatgcttataccgaaaagttacgcaggcccctttagccagcacaactatcggcaaggttacgccacacagaccgttgggccttggcacttgggaaagctcgagatcgatttcggcgaatgcccaggtactaccgtgacaattcaggaggactgtgatcatcgtggcccctctctgagaactaccacagcttccgggaaactagtcacgcagtggtgctgtaggtcatgcaccatgcctccactgcgctttctcggagaagacggctgttggtatgggatggagatccggcccctgagtgagaaggaagagaacatggtgaaaagccaagttactgccggacagggcacatcggaaaccttctccatgggtcttttgtgcctgactttatttgtggaggaatgtctcagaaggcgagtcacacgcaagcacatgattctggcagtagtgatcaccctttgcgcgataattctggggggattgacgtggatggatctcctgcgggccctaatcatgctgggcgacactatgtctggcagaattgggggacagacccatctcgctatcatggccgttttcaagatgagcccgggttacgtgctgggcgtctttcttaggaaattgacatcacgtgagaccgcactgatggtgatagggatggctatgactacaaccttaagtatccctcacgacctcatggagctgattgatggaatctcccttggcctgattctactcaagatcgtaacacagttcgacaatactcaagtgggtaccctggccttgtctctgacgtttatacgcagcacaatgtccttagtcatggcatggcggaccattatggccgttctcttcgtggtgactctgatcccactttgtagaacctcatgcctgcagaaacagagccattgggtcgaaatcacagctttgattctcggggcgcaagccctgcccgtgtatctaatgactctgatgaagggagcaagtaggcgatcttggcctcttaacgagggcatcatggctgttggcctcgtatccctgttggggagcgccctgttaaaaaatgatgtgcccctcgccggaccaatggtcgctggtggcctgcttctggcagcctacgtgatgtcggggtcatctgcggacttgagtctcgaaaaggctgccaacgttcagtgggatgagatggcagacattaccggatccagccctataatcgaagtgaagcaggatgaggacggctcttttagcattcgggatgtcgaggaaacgaatatgatcacactgctagtgaaactggcccttattaccgtatccggtctctaccccctggctatcccagtcactatgacattgtggtatatgtggcaggtgaagacccaacgctcaggggcattatgggacgttccgagtcctgccgcgactcagaaagctgccctgagcgagggagtgtacagaataatgcagaggggcctcttcggcaagacacaggtcggggtgggaatccacatggaaggtgtttttcacaccatgtggcatgtgacgcggggctctgtcatttgtcacgagactgggcgactggaaccctcctgggcagatgtgagaaacgacatgatctcatatggaggcggttggcgccttggggataaatgggacaaggaggaggacgtacaagtgctggccattgaaccaggaaagaatcccaaacatgttcagaccaagcctggcttgttcaaaacactaaccggcgagatcggggctgtcacactggatttcaagccaggaactagtggtagccccataattaacaggaaaggcaaggtgatcgggctctacggaaatggcgtggtcaccaaatccggtgactatgtatctgccatcacgcaggcagaacgtattggggagcctgattacgaggtggacgaagatatatttcggaagaagagactgacaatcatggaccttcacccgggagctggcaaaactaagaggattttaccatcgatcgttcgcgaggccctgaaacgaagactccggaccttgattctggcgcccacaagggtggtcgccgcagaaatggaggaagctctccgcggcctgcctatccgttatcagaccccagccgtgaagagcgagcatactgggagagagatagttgatcttatgtgccacgctaccttcacaacgcggctgttgtcatccactagggtgcccaactacaatctaatcgtcatggacgaagcacactttaccgatcctagttctgtggccgcccgcggatacattagcacacgagtagagatgggtgaagctgcggcaatcttcatgaccgccactccgcccggcgctacagacccatttcctcaatccaactcacccattgaggatatcgaaagagagataccagagcggtcttggaataccgggttcgactggattacggactatcagggaaaaactgtgtggtttgttcctagcatcaaggccggcaacgatatcgcaaattgcctgaggaagagtggtaaaaaggtcattcagctctcccgcaaaacattcgacaccgaataccccaagaccaaattaactgattgggactttgtggtgacaaccgatatcagcgagatgggggccaacttcagagctggcagggtcatagacccacggcgttgtctgaagccggttattcttacagatggacctgaacgcgtgatcctggcgggccccattccagtaactcccgcctctgcagctcaacgaagagggaggatcggacggaaccctgcccaggaggacgatcagtatgtgttttcaggtgacccactcaagaatgatgaagaccatgcacactggacggaggccaaaatgttgctggataacatatacacccccgagggcattatccctacactcttcgggccggaacgcgagaagactcaggctatcgacggagaattcagactgaggggcgagcaacggaaaacctttgtcgagcttatgcgaagaggtgacctaccagtgtggctgtcctataaggttgccagtgcggggattagctacaaagatcgcgaatggtgcttcacaggcgagaggaataaccagatcttggaagagaatatggaagtggagatttggacccgggagggagaaaagaagaaattacgtcccagatggctggacgcaagggtctatgccgatcctatggctctcaaggactttaaagagttcgcctcgggccgcaagtctataactctggatatccttacggaaattgcttccctgcccacctacctcagctcacgggcaaaattggccctggacaacatcgtaatgctacatacaactgagcgagggggaagagcttaccagcacgccctgaatgaactcccagagagtcttgagaccctgatgttagtggcattgctgggtgcgatgacagccggcatctttctcttctttatgcaggggaagggaattggcaagctgtctatgggtcttataaccatcgctgttgcctccgggctgctctgggtggcagaaattcaacctcagtggatcgctgccagcattatcttggagttctttctgatggtcttactaatacccgaaccagagaaacagaggactcctcaggataaccaactgatctatgtgattctcacaatccttacgattatcggcctgatagcagccaatgaaatgggattgattgagaagaccaaaactgacttcggcttttaccaggtcaagacagagaccaccatcctggatgtggacctccgcccggcttcagcgtggacactgtatgccgttgcaactacgattcttacccccatgctccggcacacaatcgaaaacactagtgctaatctgagcttggccgccatagcaaaccaggctgccgtgctgatggggttaggaaaaggctggccactacatagaatggatctgggtgtacctctccttgcgatggggtgttactcccaggtgaatcccaccacactgaccgcttctttggtcatgctgctcgttcactatgccatcattggaccaggcctgcaagcaaaggccactcgtgaggctcagaaaaggacggcagccggtatcatgaagaaccctacagtggacggcattaccgtcatcgatcttgaacccataagctacgacccgaagttcgagaaacagttagggcaagtgatgctgctcgtattgtgcgcgggacagctgctactgatgcggactacctgggctttttgtgaggtgctcacacttgccactggcccaattctgaccttgtgggaagggaatcctggacgcttctggaacacaacgatcgcagtttccaccgccaacatcttccgaggctcatatctggctggtgccgggctcgcattttctctgattaagaatgctcagactcccagaaggggaacaggcaccactggtgagacattaggcgaaaaatggaagcggcagcttaacagtctggaccgcaaagagttcgaagagtacaagagatcggggatcctcgaggtggataggaccgaagccaagagcgcgctaaaagacggatccaagataaaacatgccgtctctcgaggctcaagcaagattcggtggatcgtggagcgtgggatggtcaaaccaaagggaaaggtggttgatctgggctgcggtagagggggatggtcctactatatggcaacgttgaaaaatgtaaccgaagtgaagggctacacaaaaggcgggcccggacacgaggaacctattccgatggctacttatggttggaacctggtcaagctccatagtggcgtggacgttttttacaaacccaccgagcaagtggatacacttctgtgtgacatcggggagtctagctcaaatccaactatagaagagggacgcaccttgagggtcctgaagatggtggaaccttggctctccagtaagcccgagttctgcatcaaagtattaaacccttatatgccaacagtgattgaagagctggagaagcttcagcggaaacacggcggtaatctggttagatgtcccctaagccgcaactctacccacgaaatgtactgggtctccggggcctcaggaaatatcgtgagctcggtgaacactacgtctaagatgctcctgaataggtttacaacccgacatcggaaacctacttatgagaaggatgtcgacttgggcgcaggcaccagaagtgtttccacagaaacggagaaaccagatatgaccattatcgggaggcgcctgcagcgtctccaggaggaacacaaggagacttggcattacgaccaagaaaacccctaccggacatgggcttatcacggaagctacgaggccccgtcaaccggttccgcctctagcatggtgaatggcgtagtgaagcttctgactaaaccttgggatgtcattccaatggtgacacagttagcgatgaccgacacaactcccttcgggcagcagagagtttttaaggaaaaagtggacaccaggacgcctcaaccaaagcccggaacccgcatggtcatgacaactaccgctaactggctgtgggcattgctcggcaaaaagaagaatccgcgactgtgcacacgggaggagttcatcagtaaagtgagatccaacgccgctataggtgccgtatttcaggaagagcaggggtggactagcgcatctgaagccgttaatgattcaaggttctgggagctagtggacaaggaacgcgctcttcaccaagagggaaaatgtgagagttgcgtctataacatgatgggcaagagagaaaaaaagctgggcgagtttgggcgggcgaagggatccagggccatttggtacatgtggctcggtgcacgtttcctggaatttgaggctttgggcttcctgaacgaagatcattggttcgggcgagagaatagctggtctggagtggagggcgaaggtctccaccgccttgggtatatcctggaggaaatcgacaaaaaggatggagacttaatgtacgccgatgacaccgcaggctgggatacgagaattacagaggacgatctgcagaacgaggaattgataaccgagcagatggcccctcatcacaaaatcctcgctaaggccatttttaaactgacttatcagaataaggtggtcaaggttctacggcccacaccaaggggcgcggtgatggacatcatttcgcgcaaagatcaaagagggtcaggacaggtaggtacctacggccttaacactttcaccaatatggaagtgcagctgatccggcagatggaggcagaaggggtcataacacaagacgacatgcagaaccctaagggactcaaagagagggtggagaagtggctgcgagaatgcggcgttgatcgtttgaaaagaatggccatcagcggtgacgattgtgtggtcaagcccttagacgagcgctttgctacgtccctgctcttccttaatgatatggggaaagtgcggaaggacattccacagtgggaacccagtaagggatggaaaaactggcaggaggtacctttttgctctcatcacttccacaagatctttatgaaagatggcaggagcctggttgtgccatgtagaaatcaagacgaactaattggccgcgcccggatctcccagggggcaggatggtcactgagggagaccgcttgcctcggtaaggcctacgctcagatgtggagtttgatgtatttccatcgaagagatctgcggcttgcctctatggcaatatgtagcgcggtcccgactgagtggtttcccacatccaggaccacttggtcaattcacgcccatcaccagtggatgacaaccgaagacatgctgaaagtgtggaaccgcgtttggatcgaggataatcctaacatgatcgacaagacgccagtgcacagctgggaagacattccctacctcggcaagcgtgaggatttatggtgcgggtctctgataggattgtccagtagagctacatgggccaaaaatatccataccgcaattactcaagtccgaaacctgatcggcaaggaagagtatgtggactacatgcctgtaatgaaaaggtatagcgctccatcggagtccgaaggtgtgctctga

SEQ ID NO: 15734 - RNA, 9867 nt, synthetic construct
  misc_feature 1..9867: note = derived and/or modified CDS sequence (opt3) from DENV-4__FJ850095__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggaggactgtgatcatcgtggccccagcttgagaaccacaacggcttctgggaaactcgtcacccagtggtgctgtaggtcctgcactatgcctccactgcgctttctaggagaagacggctgttggtatgggatggagattcggcccctgtcagagaaggaagagaacatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggatctgttgcgggccctcattatgctgggcgacaccatgtccggcagaatcgggggacagacacatctagctataatggccgttttcaagatgtctccgggttacgtgctgggcgtctttctcaggaaactgaccagccgtgagactgcacttatggtgatcgggatggctatgacaaccacattgtcaattcctcacgacctgatggagttaatcgatggaattagtctcggcctgatccttctgaagatagtaactcagttcgacaatacccaagtgggtacgctagccctctccctgacatttattcgctctaccatgagcttggtcatggcatggcggactatcatggccgttctgttcgtggtgaccttaatcccactctgtagaacatcctgcctgcagaaacagtcacattgggtcgaaattactgctcttatcctgggggcgcaagccttgcccgtgtatctcatgaccctgatgaagggagcaagcaggcgaagttggcctctaaacgagggcattatggctgttggcctggtatctcttctcgggtccgccctgttgaaaaatgatgtgcccctggccggaccaatggtcgctggtggcttactcctggcagcctacgtgatgagcgggtcgtcagcggacctttctctggaaaaggctgccaacgttcagtgggatgagatggcagacataacgggaagttcccctatcattgaagtgaagcaggatgaggacggcagcttttctatccgggatgtcgaggaaacaaatatgattaccttgctcgtgaaactggccctaatcactgtaagcggtctgtacccccttgctataccagtcacaatgaccctctggtatatgtggcaggtgaagactcaacgctccggggcactgtgggacgttccgtcacctgccgcgacacagaaagctgccttgagtgagggagtgtacagaatcatgcagaggggcttattcggcaagacccaggtcggggtgggaattcacatggaaggtgttttccacacgatgtggcatgtgactcggggcagcgtcatctgtcacgagaccgggcgactggaaccctcttgggcagatgtgagaaacgacatgatttcctatggaggcggttggcgcctcggggataaatgggacaaggaggaggacgtacaagtgctggccatcgaaccaggaaagaatcccaaacatgttcagacaaagcctggcctttttaaaaccctgacaggcgagataggggctgtcactttggatttcaagccaggaacctcaggtagtcccattatcaacaggaaaggcaaggtgatcgggctatacggaaatggcgtggtcacgaaaagcggtgactatgtatccgccattacacaggcagaacgtataggggagcctgattacgaggtggacgaagatatctttcggaagaagagactgactattatggacctccacccgggagctggcaaaaccaagaggatcctgccatctattgttcgcgaggcccttaaacgaagattacggacactgatcctcgcgcccaccagggtggtcgccgcagaaatggaggaagctttgcgcggcctgcctatacgttatcagactccagccgtgaagtcggagcataccgggagagagatcgttgatctcatgtgccacgctacattcacgactcggctgcttagctcaaccagggtgcccaactacaatctgattgtcatggacgaagcacactttacagatccttccagtgtggccgcccgcggatacatctctacccgagtagagatgggtgaagctgcggcaattttcatgactgccacaccgcccggcgctaccgacccatttcctcaaagcaactcccccatcgaggatatagaaagagagattccagagcggtcatggaatacggggttcgactggatcactgactatcagggaaaaacagtgtggtttgttccttctatcaaggccggcaacgatattgcaaattgcttgaggaagagcggtaaaaaggtcatccagctaagtcgcaaaaccttcgacaccgaataccccaagactaaactgacagattgggactttgtggtgaccacagatatatccgagatgggggccaacttcagagctggcagggtcattgacccacggcgttgtctcaagccggttatcttaactgatggacctgaacgcgtgattctggcgggccccatcccagtaacgcccgccagcgcagctcaacgaagagggaggataggacggaaccctgcccaggaggacgatcagtatgtgttctctggtgacccacttaagaatgatgaagaccatgcacactggaccgaggccaaaatgctgctcgataacatttacacacccgagggcatcatccctactttgtttgggccggaacgcgagaagacccaggctattgacggagaattcagactgaggggcgagcaacggaaaacatttgtcgagctcatgcgaagaggtgacctgccagtgtggctttcatataaggttgcctccgcggggatcagttacaaagatcgcgaatggtgcttcaccggcgagaggaataaccagattctagaagagaatatggaagtggagatatggactcgggagggagaaaagaagaaactgcgtcccaagtggttggacgcaagagtctatgccgatcctatggctttaaaagactttaaggagttcgccagcggcaggaaatcgatcacgctggatattctcaccgaaatcgcttctctgcccacatacctttccagccgcgcaaagctggccctcgacaacatcgtaatgttgcatactaccgagcgggggggacgagcttaccagcacgccctgaatgaactaccagagtcactggagacactcatgcttgtggcactgttaggtgcgatgaccgccggcatttttttgttctttatgcaggggaagggaataggcaaactgagtatgggtctcatcactattgctgttgcctctgggctgctttgggtggcagaaatccaacctcagtggattgctgcctccatcatactggagttctttctcatggtcttgctgatccccgaaccagagaagcagagaacacctcaggataaccaattaatttatgtgatcctaacgattctgaccatcataggcctcattgcagccaatgaaatgggacttatcgagaaaactaagacagacttcggcttttaccaggtcaaaaccgagaccacaattctggatgtggacttgaggccggctagcgcgtggactctgtatgccgttgcaacgaccatcctcacacccatgctgcgccacactatagaaaacacctcagctaatcttagtctcgccgccatcgcaaaccaggctgccgtgctgatggggttgggaaagggctggccactgcatcggatggatttaggtgtacctctactggcgatggggtgttacagccaggtgaatcccacaaccctcactgcttcccttgtcatgctgttggttcactatgccattatcggaccaggcctgcaagcaaaagccacgagagaggctcagaagcgtacagcagccggtattatgaagaaccctaccgtggacggcatcactgtcatagatctcgaacccatttcttacgacccgaaattcgagaagcagctggggcaagtgatgcttttagtactgtgcgcgggacagctcttgctgatgaggaccacatgggctttctgtgaggtgctaactctggccaccggcccaatcctcacactttgggaagggaatcctggacggttttggaacacgaccatcgcagttagcactgccaacattttccgcggctcctatctggctggtgccgggttggcattttcactgatcaaaaatgctcagacaccccgaagaggaaccggcactacaggtgagaccctcggcgaaaagtggaaaaggcagctgaactctttagaccggaaggagttcgaagagtacaagcgcagtgggatacttgaggtggatagaacggaagccaaatcggcgctgaaggacggaagcaaaattaagcatgccgtctccaggggctcttcaaaaatccgatggattgtggagcgggggatggtcaagccaaagggaaaagtggttgatctcggctgcggtcgtgggggatggagctactatatggcaaccctaaagaatgtaacagaagtgaaaggctacactaagggcgggcccggacacgaggaacctatcccgatggctacctatggttggaacctggtcaaattgcattccggcgtggacgttttttacaagcccacagagcaagtggatactctgctctgtgacataggggagagttctagcaatccaaccatcgaagagggaagaacacttcgcgtcctgaagatggtggaaccttggttgtcatccaaacccgagttctgcattaaggtactgaacccttatatgccaaccgtgatcgaagagctcgagaaattacagaggaagcacggcggtaatctggttcggtgtccccttagtagaaacagcactcacgaaatgtactgggtctctggggcctccggaaatattgtgtcaagcgtgaacacgacatcgaaaatgctgctaaatcgctttaccactaggcatcgaaagcctacctatgagaaagatgtcgacctcggcgcaggcacacggtctgttagtacggaaaccgagaagccagatatgactatcattgggagaaggctgcagcgcttgcaggaggaacacaaggagacatggcattacgaccaagaaaacccctaccgtacctgggcttatcacggatcctacgaggccccgagcactggttcagcctcctctatggtgaatggcgtagtgaaactgctcacaaagccttgggatgtcatcccaatggtgacccagcttgcgatgacagacactacccccttcgggcagcagcgggtttttaaagaaaaggtggacacgagaacccctcaaccaaaacccggaacaaggatggtcatgactaccacagctaactggctgtgggcattactgggcaagaagaaaaatccgcgcttgtgcactcgagaggagttcataagcaaggtgcggagtaacgccgctattggtgccgtatttcaggaagagcaggggtggacctccgcaagcgaagccgttaatgattctagattctgggagctcgtggacaaagaaagggctctgcaccaagagggaaagtgtgagtcatgcgtctataacatgatgggcaaacgcgaaaagaagctaggcgagtttgggagagcgaaaggaagtcgggccatctggtacatgtggcttggtgcaaggttcctggaattcgaggctctcggctttctgaacgaagatcattggttcgggcgtgagaattcctggagcggagtggagggcgaaggtttgcaccgactggggtatatcctcgaggaaattgacaagaaagatggagaccttatgtacgccgatgacacggcaggctgggatacacgcataaccgaggacgatctgcagaacgaggaattaatcactgagcagatggcccctcatcacaagattctggctaaagccatctttaagttgacatatcagaataaggtggtcaaagttctcagacccaccccacggggcgcggtgatggacattatctctaggaaggatcaacgcgggtcgggacaggtaggtacttacggcctgaacaccttcacaaatatggaagtgcagctaataagacagatggaggcagaaggggtcatcacgcaagacgacatgcagaaccctaaaggacttaaggagcgggtggagaaatggctgagggaatgcggcgttgatcgactcaagcgtatggccatttcaggtgacgattgtgtggtcaaacccctggacgagagatttgggaccagcttgttattcctgaatgatatgggaaaggtgcgcaaggacatcccacagtgggaaccctccaaaggctggaagaactggcaggaggtacctttttgcagtcatcacttccacaaaatttttatgaaggatggccggtctctcgttgtgccatgtaggaatcaagacgaacttatcgggagagctcgcataagccagggagccggttggtccctgcgggagactgcatgcctaggcaaagcttacgcccagatgtggtcactgatgtatttccataggcgagatctcagattggctagtatggccatttgttctgcagtcccgacagagtggtttcccaccagccggactacatggtccatccacgcgcatcaccagtggatgaccacggaagacatgctgaaggtgtggaacagggtttggatcgaggataatcctaacatgattgacaagacaccagtgcactcatgggaagacataccctaccttgggaaacgcgaggatctgtggtgcggaagcctcatcggcttatcttcccgtgccacctgggctaagaatattcatactgccatcacccaagtcagaaacctgattggtaaagaagagtatgtggactacatgcctgtaatgaagcgatatagtgcaccaagcgagtcggaaggggtgttgtga

SEQ ID NO: 15735 - RNA, 9867 nt, synthetic construct
  misc_feature 1..9867: note = derived and/or modified CDS sequence (opt3) from DENV-4__FJ639748__SS-prME
  source 1..9867: mol_type = other RNA
agcaccatgacactgctctgccttatccccactgccatggctttccacctgtccacgagagacggcgagcctttgatgattgtggcaaagcatgaaagggggcggccattactgtttaaaaccacagagggaataaacaagtgtactctaatcgccatggatctcggtgaaatgtgcgaggacaccgtcacatacaaatgtccgctgcttgttaataccgaacccgaggatattgactgctggtgtaacctgacttctacatgggtgatgtatggcacctgcacgcagtcaggggagcgccgacgtgaaaagagaagtgtagcgttgactcctcacagcggaatgggcctcgagaccagggctgaaacatggatgtcctctgagggtgcctggaaacatgcacaacgggtggagtcgtggatcctgcgcaatccagggttcgccctgctcgctggatttatggcatacatgattggccagactggcatccagagaaccgtcttctttgtgttaatgatgctggttgccccctcatatgggatgaggtgtgtgggagtcggtaaccgggatttcgtggaaggcgtaagcgggggagcttgggttgaccttgtgttggagcacggcggttgcgtcacaaccatggcccaggggaagcctacgctggattttgaactaactaagacaaccgcgaaagaggtggcactcctgcgcacttactgtatagaagcccttatcagtaatattacaaccgctacgcgatgcccaacccaaggagagccctatctgaaggaggaacaggaccagcagtacatctgtagaagggatgtggtcgaccggggctggggcaacgggtgcggattgttcggtaaaggcggggttgtgacatgcgccaagttttcctgttctggaaaaattactggcaatctcgtacaaatcgagaacctggaatataccgtggtcgtgacagttcataatggtgatactcacgcagtggggaacgacaccagcaatcacggcgtcacagctaccataactcctcgttccccatcagtggaggtacagttaccggattacggagaactgacgctcgactgcgagccccgcagtggcattgacttcaacgagatgatccttatgaagatgaagaaaaagacatggctggttcataaacagtggtttttggatctacctctgccatggaccgccggggcggacactagcgaagtgcactggaattacaaggagagaatggtcaccttcaaagtgccccatgccaagaggcaggatgtcacagtgctcggatctcaagaaggtgcaatgcactccgctctggccggcgctaccgaggttgactcaggggatggaaaccacatgtttgccggccatcttaaatgtaaggtgcggatggaaaagctgcgaattaaaggtatgagctatactatgtgcagtgggaagttctctatcgacaaagagatggcagagacacagcacggcacgaccgtagtcaaggtgaaatacgaaggagccggcgctccttgtaaggttccaatcgagattcgcgatgtgaataaggaaaaagtcgtggggagagtaatatccagcactcccttggcggagaacacaaactcggtgaccaatatcgagctcgaaccgcctttcggagactcttatattgttatcggtgtcggcaactccgcactgacattacattggtttaggaaggggtcaagtataggaaaaatgttcgagagcacttaccggggcgccaagcgcatggctattctgggtgaaaccgcctgggattttgggtccgtgggcggactattcacgtctctcggcaaagcagtgcaccaggtctttgggagcgtttataccacaatgttcggaggcgtgtcatggatgatcagaatcctgattggtcttttggtgctgtggatcgggactaatagtaggaacacctccatggccatgacatgcattgctgtaggaggcataactctctttctgggtttcaccgtccaagccgacgtgggctgtgttgtgagctggtctgggcgtgagcttaagtgcggatcaggcatctttgtcgtggataatgttcatacgtggacagaacagtacaagttccagcccgagagtccagcacggctggcgagcgctattttgaacgcccacaaagacggggtgtgtggaatccgatccaccactagactcgagaatgtaatgtggaagcagatcacaaacgaactgaattatgtcttatgggagggcggtcacgacctgaccgtggtggcaggggatgtcaaaggagttctaactaagggcaaaagggccctcacccctcccgtgtctgacctgaagtactcgtggaagacatggggtaaagctaagatttttacgccagaagcccgcaacagcaccttccttatagatggccccgacacttccgagtgccctaatgaacggagagcatggaactcattggaggtagaggattacgggtttggaatgttcacaaccaatatctggatgaaattcagggaaggcagttctgaggtgtgtgaccatcgcctgatgagcgctgccattaaggatcaaaaagcggtccacgccgacatggggtattggatcgaatcctcaaagaaccagacatggcagattgagcgagctagcctcatcgaagtgaaaacttgcctgtggccaaagacccatacgttatggtctaatggagttctggagtcccagatgcttataccgaagagttacgcaggcccctttagccaacacaactatcggcagggttacgccacacagaccgtggggccttggcacttgggaaaactcgagatcgatttcggcgaatgcccaggtactaccgtcacaattcaggaggactgtgatcatcgtggcccctctctgagaactaccacagcttccgggaagctagtgacgcaatggtgctgtaggtcatgcaccatgcctccactgcgctttctcggagaagacggctgttggtatgggatggagatccggcccctgagtgagaaagaagagaacatggttaagagccaggtgactgccggacagggcacatcggaaaccttctccatgggtcttttgtgcctgactttatttgtcgaggaatgtctcagaaggcgagtaacacgcaaacacatgattctggcagtggttatcaccctttgcgcgataattctggggggattgacgtggatggatctcctgcgggccctaatcatgctgggcgacactatgtctggcagaattgggggacagacccatctcgctatcatggccgtgttcaagatgagcccgggttacgtcctgggcgtgtttcttaggaagttgacatcacgtgagaccgcactgatggtaatagggatggctatgactacaaccttaagtatccctcacgacctcatggagctgattgatggaatctcccttggcctgattctactcaaaatcgtgacacaattcgacaatactcaggtcggtaccctggccttgtctctgacgtttatacgcagcacaatgtccttagttatggcatggcggaccattatggccgtgctcttcgtggtcactctgatcccactttgtagaacctcatgcctgcagaagcaaagccattgggtggaaatcacagctttgattctcggggcgcaggccctgcccgtttatctaatgactctgatgaaaggagcaagtaggcgatcttggcctcttaacgagggcatcatggctgtaggcctcgtgtccctgttggggagcgccctgttaaagaatgatgtccccctcgccggaccaatggtggctggtggcctgcttctggcagcctacgttatgtcggggtcatctgcggacttgagtctcgaaaaagctgccaacgtgcagtgggatgagatggcagacattaccggatccagccctataatcgaagtcaagcaggatgaggacggctcttttagcattcgggatgtggaggaaacgaatatgatcacactgctagtaaagctggcccttattaccgtctccggtctctaccccctggctatcccagtgactatgacattgtggtatatgtggcaagttaaaacccagcgctcaggggcattatgggacgtgccgagtcctgccgcgactcagaaggctgccctgagcgagggagtctacagaataatgcagaggggcctcttcggcaaaacacaagtgggggttggaatccacatggaaggtgtgtttcacaccatgtggcatgtcacgcggggctctgtgatttgtcacgagactgggcgactggaaccctcctgggcagatgtaagaaacgacatgatctcatatggaggcggttggcgccttggggataagtgggacaaagaggaggacgtgcaggttctggccattgaaccaggaaagaatcccaagcatgtccagaccaaacctggcttgttcaagacactaaccggcgagatcggggctgtgacactggatttcaaaccaggaactagtggtagccccataattaacaggaagggcaaagtgatcgggctctacggaaatggcgtcgtaaccaagtccggtgactatgtgtctgccatcacgcaggcagaacgtattggggagcctgattacgaggttgacgaagatatatttcggaaaaagagactgacaatcatggaccttcacccgggagctggcaagactaaaaggattttaccatcgatcgtgcgcgaggccctgaagcgaagactccggaccttgattctggcgcccacaagggtcgtggccgcagaaatggaggaagctctccgcggcctgcctatccgttatcaaaccccagccgttaaaagcgagcatactgggagagagatagtggatcttatgtgccacgctaccttcacaacgcggctgttgtcatccactagggtccccaactacaatctaatcgtgatggacgaagcacactttaccgatcctagttctgtagccgcccgcggatacattagcacacgagtggagatgggtgaagctgcggcaatcttcatgaccgccactccgcccggcgctacagacccatttcctcagtccaactcacccattgaggatatcgaaagagagataccagagcggtcttggaataccgggttcgactggattacggactatcagggaaagactgtttggtttgtccctagcatcaaagccggcaacgatatcgcaaattgcctgaggaagagtggtaagaaagtgattcaactctcccgcaagacattcgacaccgaataccccaaaaccaagttaactgattgggactttgtggtcacaaccgatatcagcgagatgggggccaacttcagagctggcagggttatagacccacggcgttgtctgaaaccggtgattcttacagatggacctgaacgcgtaatcctggcgggccccattccagtgactcccgcctctgcagctcagcgaagagggaggatcggacggaaccctgcccaggaggacgatcagtatgtcttttcaggtgacccactcaagaatgatgaagaccatgcacactggacggaggccaagatgttgctggataacatatacacccccgagggcattatccctacactcttcgggccggaacgcgagaaaactcaagctatcgacggagaattcagactgaggggcgagcagcggaagacctttgtggagcttatgcgaagaggtgacctaccagtttggctgtcctataaagtggccagtgcggggattagctacaaggatcgcgaatggtgcttcacaggcgagaggaataaccagatcttggaagagaatatggaagtcgagatttggacccgggagggagaaaaaaagaagttacgtcccagatggctggacgcaagggtatatgccgatcctatggctctcaaagactttaaggagttcgcctcgggccgcaaatctataactctggatatccttacggaaattgcttccctgcccacctacctcagctcacgggcaaagttggccctggacaacatcgtgatgctacatacaactgagcgagggggaagagcttaccagcacgccctgaatgaactcccagagagtcttgagaccctgatgttagttgcattgctgggtgcgatgacagccggcatctttctcttctttatgcaagggaaaggaattggcaagctgtctatgggtcttataaccatcgctgtggcctccgggctgctctgggtcgcagaaattcagcctcagtggatcgctgccagcattatcttggagttctttctgatggtgttactaatacccgaaccagagaagcagaggactcctcaagataaccagctgatctatgtcattctcacaatccttacgattatcggcctgatagcagccaatgaaatgggattgattgagaaaaccaagactgacttcggcttttaccaggtgaaaacagagaccaccatcctggatgttgacctccgcccggcttcagcgtggacactgtatgccgtggcaactacgattcttacccccatgctccggcacacaatcgaaaacactagtgctaatctgagcttggccgccatagcaaaccaggctgccgtactgatggggttaggaaagggctggccactacatagaatggatctgggtgtgcctctccttgcgatggggtgttactcccaagtcaatcccaccacactgaccgcttctttggttatgctgctcgtgcactatgccatcattggaccaggcctgcaggcaaaagccactcgtgaggctcagaagaggacggcagccggtatcatgaaaaaccctacagtcgacggcattaccgtgatcgatcttgaacccataagctacgacccgaagttcgagaagcaattagggcaggtaatgctgctcgtgttgtgcgcgggacagctgctactgatgcggactacctgggctttttgtgaggttctcacacttgccactggcccaattctgaccttgtgggaagggaatcctggacgcttctggaacacaacgatcgcagtgtccaccgccaacatcttccgaggctcatatctggctggtgccgggctcgcattttctctgattaaaaatgctcagactcccagaaggggaacaggcaccactggtgagacattaggcgaaaagtggaaacggcaacttaacagtctggaccgcaaggagttcgaagagtacaaaagatcggggatcctcgaggtcgataggaccgaagccaagagcgcgctaaaggacggatccaaaataaagcatgccgtgtctcgaggctcaagcaaaattcggtggatcgtcgagcgtgggatggtgaagccaaaaggaaaggttgtagatctgggctgcggtagagggggatggtcctactatatggcaacgttgaagaatgtgaccgaagtcaaaggctacacaaagggcgggcccggacacgaggaacctattccgatggctacttatggttggaacctggtgaaactccatagtggcgttgacgtgttttacaagcccaccgagcaggtcgatacacttctgtgtgacatcggggagtctagctcaaatccaactatagaagagggacgcaccttgagggtgctgaaaatggtagaaccttggctctccagtaagcccgagttctgcatcaaggtgttaaacccttatatgccaacagttattgaagagctggagaaacttcagcggaagcacggcggtaatctggtcagatgtcccctaagccgcaactctacccacgaaatgtactgggtgtccggggcctcaggaaatatcgtgagctcggtcaacactacgtctaaaatgctcctgaataggtttacaacccgacatcggaagcctacttatgagaaagatgttgacttgggcgcaggcaccagaagtgtgtccacagaaacggagaagccagatatgaccattatcgggaggcgcctgcagcgtctccaagaggaacacaaagagacttggcattacgaccaggaaaacccctaccggacatgggcttatcacggaagctacgaggccccgtcaaccggttccgcctctagcatggtaaatggcgtggtcaagcttctgactaagccttgggatgtgattccaatggttacacagttagcgatgaccgacacaactcccttcgggcagcaaagagtgtttaaagaaaaggtcgacaccaggacgcctcagagtaaaccaggaacccgcatggtgatgacaactaccgctaactggctgtgggcattgctcggcaagaaaaagaatccccgactgtgcacacgggaggagttcatctccaaggtaagaagcaacgccgctataggtgccgtttttcaggaagagcaagggtggacttctgcatcagaagccgtgaatgatagtaggttctgggagctagtcgacaaagaacgcgctcttcaccaggagggaaagtgtgagtcctgcgtgtataacatgatgggcaaaagagaaaagaaactgggcgagtttgggcgggcgaagggaagcagggccatttggtacatgtggctcggtgcacgtttcctggaatttgaggctttgggcttcctgaacgaagatcattggttcgggcgagagaattcttggtcgggagtggagggcgaaggtctccaccgccttgggtatatcctggaggaaatcgacaagaaagatggagacttaatgtacgccgatgacaccgcaggctgggatacgagaattacagaggacgatctgcagaacgaggaattgataaccgagcagatggccccgcatcacaagatcctcgctaaagccatttttaagctgacttatcaaaataaagtcgttaaggtgctacggcctacacccaggggcgcggtaatggacatcatttcacgcaaggatcagagagggagcggacaggtgggtacctacggccttaacactttcaccaatatggaagtccagctgatccggcaaatggaggcagaaggggtgataacacaggacgacatgcagaacccaaaaggactcaaggagagggttgagaaatggctgcgagaatgcggcgtggatcgtttgaagagaatggccatctccggtgacgattgtgtcgtgaaacctttagacgagcgctttgctacgagtctgctcttccttaatgatatggggaaggtacggaaagacattccccagtgggaaccatctaagggatggaagaactggcaagaggttcccttttgcagccatcacttccacaaaatctttatgaaggatggcaggtccctggtggtcccttgtagaaatcaggacgaactaattggccgcgcccggatctcacagggggcaggatggagtctgagggagaccgcttgcctcggtaaagcctacgctcagatgtggtctttgatgtatttccatcgaagagatctgcggcttgccagcatggcaatatgttccgcggtgccaactgagtggtttccgacatcaaggaccacttggagcattcacgcccatcaccaatggatgacaaccgaagacatgctgaaggtttggaaccgcgtgtggatcgaggataatcccaacatgatcgacaaaacgcctgtccactcttgggaagacattccatacctcggcaagcgtgaggatttatggtgcgggtccctgataggattgagtagcagagctacatgggccaagaatatccataccgcaattactcaggtgcgaaacctgatcggcaaagaagagtatgtagactacatgcccgtgatgaagaggtattcggctccttccgagaatgaaggtgtcctctga

SEQ ID NO: 15736 - RNA, 9867 nt, synthetic construct
  misc_feature 1..9867: note = derived and/or modified CDS sequence (opt3) from DENV-4__FJ639764__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaactaacaagtgtaccctaatcgcaatggatctcggtgaaatgtgcgaggacacagttacctacaaatgtccgctgcttgtgaatactgaacccgaggatattgactgctggtgtaacctgacatctacctgggtaatgtatggcacgtgcactcagtcaggggagcgccgacgtgaaaagagaagtgtggccttgacccctcacagcggaatgggcctcgagacaagggcggaaacttggatgtcctctgagggtgcttggaaacatgcccaacgggtcgagtcgtggatcctgcgcaatccagggttcgcactgctcgccggatttatggcttacatgattggccagaccggcatccagagaacagtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgaccacgatggctcaggggaagcctactctggattttgaactaacaaagaccactgccaaagaggtggcgctcctgcgcacatactgtatagaagcacttatcagtaatattaccacggccacccgatgcccaacacaaggagagccctatctgaaggaggaacaggaccagcagtacatctgtagaagggatgtcgttgaccggggctggggcaacgggtgcggattgttcggtaaaggcggggtggtaacttgcgctaagttttcctgttctggaaaaattaccggcaatctcgtgcaaatcgagaacctggaatatacagtcgtggttactgtgcataatggtgatacccacgccgtcgggaacgacacaagcaatcacggcgtgaccgcaactataacgcctcgttccccatcagtagaggttaagttaccggattacggagaactgacactcgactgcgagccccgcagtggcattgacttcaacgagatgatccttatgaagatgaaaaagaaaacctggctggtgcataagcagtggtttttggatctacctctgccatggactgctggggccgacaccagcgaagtccactggaattacaaagagagaatggtgacattcaaggtcccccatgcgaaaaggcaggatgtgaccgttctcggatctcaggaaggtgccatgcactccgcactggctggcgccactgaggtggactcaggggatggaaaccacatgtttgctggccatcttaagtgtaaggtacggatggaaaaactgcgaattaagggtatgagctatacaatgtgcagtgggaaattctctatcgacaaggagatggccgagacgcaacacggcaccactgtcgtgaaagttaagtacgaaggagcaggcgccccttgtaaggtgccaatcgagattcgcgatgtcaataaagaaaaggtggtagggagagtgatatccagcacacccttggctgagaacaccaactcggttacaaatatcgagctcgaaccgcctttcggagactcttatattgtcatcggtgtgggcaactccgcgctgactttacattggtttaggaaagggtcaagtataggaaagatgttcgagagcacctaccggggcgcaaaacgcatggccattctgggtgaaacggcttgggattttgggtccgtgggcggactattcacctctctcggcaaggccgtccaccaggtttttgggagcgtgtatacaactatgttcggaggcgtgtcatggatgatcagaatcctgattggttttcttgtattgtggatcgggaccaatagtaggaacacatccatggcaatgacttgcattgccgtcggaggcataaccctgttcctcggttttacggtgcaggctgacatgggctgtgttgtgagctggtctgggcgtgagctgaagtgcggatcaggcatcttcgtcgtggataatgttcatacatggattgaacaatacaaatttcagcccgagagtccagcccggcttgcaagcgcgatcctgaacgctcacaaggacggggtgtgtggaatccgatccaccactagattggagaatgtaatgtggaaacagattacaaacgaactcaattatgtcctgtgggagggcggtcacgacttaaccgtggtggccggggatgtcaagggagttctgactaaaggcaagaggaccctaacacctcccgtgtctgacctcaagtactcgtggaaaacgtggggtaaggcaaaaatattcaccccagaagcccgcaacagcacttttctgatcgatggccccgacacatccgagtgccctaatgaacggagagcttggaactcacttgaggtagaggattacgggttcggaatgttcaccacaaatatttggatgaagtttagggaaggcagttctgaggtgtgtgaccatcgcttgatgagcgccgcaatcaaagatcagaaggctgtccacgccgacatggggtattggattgaatcctcaaaaaaccaaacttggcagatcgagcgagcgagcctgatagaagtgaagacctgcctctggccaaagacgcatacactgtggtctaatggagttttagagtcccagatgctgatcccgaaaagttacgccggccccttcagccagcacaactatcggcaaggttacgctacccagactgtggggccttggcaccttggaaagttggagattgattttggcgaatgcccaggtaccacagtcactatccaggaggactgtgatcatcgtggcccctctctcagaaccacaacggcatccgggaaactggtgacccagtggtgctgtaggtcatgcactatgcctccactacgcttcctgggagaagacggctgttggtatgggatggagattcggcccctcagtgagaaggaagagaacatggttaaaagccaagtgacagccggacagggcacctcggaaactttttccatgggtctgctttgcttgacactgttcgtcgaggaatgtttaagaaggcgagtaacccgcaagcacatgatcctcgctgtggttataacgctgtgcgccattatccttgggggactgacttggatggatttgctccgggcactgattatgctaggcgacaccatgtctggcagaatcgggggacagacacatctggcgataatggccgtgtttaagatgagcccgggttacgtcctcggcgtgttcctgaggcgtcttacctcacgcgagactgctttgatggtaatcgggatggccatgacaaccacactgagtattcctcacgacttaatggagctcatcgatggaatttccctgggccttatcctgctaaaaatagtgactcagtttgacaatacccaagtcggtacgctcgcactgtctttgacattcattcggagcaccatgtccctggttatggcttggagaactatcatggccgtgttatttgtggtcaccctcatcccactgtgtaggacatcatgccttcagaagcagagccattgggtggaaattactgcactgatcttgggggcccaagctctccccgtttatctgatgaccctaatgaaaggagcgagtcgacggtcttggcctctgaacgagggcattatggccgtaggccttgtgtccctcctggggagcgcattgctgaagaatgatgtccccttagctggaccaatggtggccggtggcctcctgcttgccgcttacgttatgtcggggtcatctgcagacctgagtttggaaaaagccgcgaacgtgcagtgggatgagatggctgacataacgggatccagccctatcattgaagtcaagcaggatgaggacggctctttcagcatccgcgatgtggaggaaacaaatatgattaccctcctggtaaagctagccctgatcactgtctccggtctttaccccctcgcaataccagtgacaatgaccctgtggtatatgtggcaggttaaaactcaaagatcaggggccttgtgggacgtgccgagtcctgctgcaacacagaaggccgcgttaagcgagggagtctacaggatcatgcagcggggcctgtttggcaaaacccaggtgggggttggaattcacatggaaggtgtgttccacacgatgtggcatgtcactcgaggctctgtgatctgtcacgagaccgggagactcgaaccctcctgggctgatgtacgcaacgacatgatttcatatggaggcggttggaggctgggggataagtgggacaaagaggaggacgtgcaagttcttgccgtcgaaccaggaaagaatcccaagcatgtgcagacaaaacctggcctgttcaagaccatcacaggcgagataggggcagtgactttggattttaaaccaggaaccagtggtagccccattatcaaccgtaagggcaaagtcatcgggctatacggaaatggcgtagtgacgaagtccggtgactatgtttctgccattacacaggctgaacggataggggagcctgattacgaggtggacgaagatatcttcagaaaaaagaggctgactattatggacctccacccgggagccggcaagaccaaacgcatcctgccatcgattgtccgagaggcacttaagagacggttaaggacactgatcctcgctcccacccgcgtggttgccgcggaaatggaggaagccttgcgtggcctgcctataagatatcagactccagcagtgaaaagcgagcataccgggcgggagatcgtcgatctcatgtgccacgctacatttacgactaggctgctttcatccacccgcgtgcccaactacaatctgattgtaatggacgaagcccacttcacagatcctagttctgtggctgcacgaggatacatcagcaccagagttgagatgggtgaagccgccgctatttttatgactgcgacaccgcccggcgcaaccgacccattccctcaatccaactcacccatcgaggatatagaacgggagattccagagaggtcttggaatacggggtttgactggatcactgactatcagggaaagacagtctggttcgtgcctagcatcaaagccggcaacgatattgctaattgcttgcgcaagagtggtaagaaagtgatccagctatccagaaagacctttgacaccgaataccccaaaactaagctgacagattgggacttcgtcgttaccacagatataagcgagatgggggccaactttagggcaggccgggtgattgacccacgtcgctgtctcaaaccggtaatcttaactgatggacctgaacgagtgattctggccggccccatcccagtcacgcccgcttctgcggcccaaagaagggggcggataggacgcaaccctgcacaggaggacgatcagtatgtgttctcaggtgacccacttaagaatgatgaagaccatgctcactggaccgaggccaagatgctgctcgataacatttacacacccgagggcatcatccctactttgttcgggccggaaagagagaaaacccaggcaattgacggagaatttaggctgcggggcgagcaacgaaagacattcgttgagctcatgagacgcggtgacctgccagtgtggctttcctataaagtcgccagtgctgggatcagctacaaggatagggaatggtgctttaccggcgagcggaataaccagattctagaagagaatatggaagtagagatatggactcgtgagggagaaaaaaagaagctgagacccaggtggttggacgcccgcgtgtatgcggatcctatggcattaaaagacttcaaggagtttgcctcgggccggaaatctatcacgctggatattctcaccgaaatcgcttccctgcccacataccttagctcacgagccaagctggctctcgacaacatcgttatgttgcatactaccgagagagggggaagggcataccagcacgccctgaatgaactaccagagagtctggagacactcatgcttgtggctctgttaggtgccatgaccgcaggcattttcttgtttttcatgcaggggaaaggaataggcaagctgtctatgggtctcatcactattgcggtcgcctccgggctgctttgggtggctgaaatccaacctcagtggattgccgcaagcatcatactggagtttttcctcatggtcttgctgatccccgaaccagagaagcagcgcacacctcaggataaccaattaatttatgtgatcctaacgattctgaccatcataggcctcattgctgccaatgaaatgggacttatcgagaaaactaagacagactttggcttctaccaggttaaaaccgagaccacaattctggatgtggacttgcggccggcatcagcctggactctgtatgctgtagcgacgaccatcctcacacccatgctgagacacactatagaaaacaccagtgccaatcttagcctcgcagctatcgccaaccaggccgcagtgctgatggggttgggaaagggctggccactgcatcgtatggatttaggtgtccctctactggctatggggtgttactcccaggttaatcccacaaccctcactgcctctcttgtgatgctgttggtccactatgcgattatcggaccaggcctgcaagctaaagccacgagggaggcacagaagcggacagccgctggtattatgaaaaaccctaccgtggacggcatcactgtaatagatctcgaacccattagctacgacccgaagtttgagaagcagctggggcaagtgatgcttttagttctgtgcgcaggacagctcttgctgatgcgcaccacatgggccttctgtgaggtgctaactctggcgaccggcccaatcctcacactttgggaagggaatcctggacgattctggaacacgaccatcgctgtctccactgccaacatttttagaggctcatatctggcaggtgccgggttggctttctctctgatcaaaaatgcccagacacccaggcggggaaccggcactacaggtgagaccctcggcgaaaagtggaaacgccagctgaacagtttagacagaaaggagtttgaagagtacaaaaggtcggggatacttgaggtggatcgaacggaagcaaagagcgctctgaaggacggatccaaaattaagcatgccgtctctcggggctcaagcaaaatccgttggattgtggagagagggatggttaagccaaaaggaaaggtagtggatctcggctgcggtcgcgggggatggtcctactatatggcgaccctaaagaatgtcacagaagtgaaaggctacactaagggcgggcccggacacgaggaacctatcccgatggccacctatggttggaacctggttaaattgcatagtggcgtggacgtcttctacaagcccacagagcaagtggatactctgctctgtgacataggggagtctagctcaaatccaaccatcgaagagggaaggacacttcgggtactgaaaatggtggaaccttggttgtccagtaagcccgagttttgcattaaggttctgaacccttatatgccaaccgtcatcgaagagctcgagaaattacagagaaagcacggcggtaatctggtgcgctgtccccttagcaggaactctactcacgaaatgtactgggtgtccggggcatcaggaaatattgtcagctcggttaacacgacatctaaaatgctgctaaatcgattcaccactcggcatagaaagcctacctatgagaaagatgtggacctcggcgctggcacaaggagtgtatccacggaaaccgagaagccagatatgactatcattgggcgccgtctgcagcggttgcaggaggaacacaaagagacatggcattacgaccaagaaaacccctacagaacctgggcctatcacggaagctacgaggcaccgtcaactggttccgcttctagcatggtgaatggcgtcgtgaagctgctcacaaagccttgggatgttatcccaatggtgacccagcttgccatgacagacactaccccctttgggcagcagagggtcttcaaagaaaaggtggacacgcgcacccctcaaccaaaacccggaacacgaatggtaatgactaccacagccaactggctgtgggcgttactgggcaagaaaaagaatccgcggttgtgcactagagaggagtttataagtaaggttaggtccaacgctgcaattggtgccgtgttccaggaagagcaggggtggaccagcgcttctgaagccgtcaatgattcacgcttttgggagctcgtggacaaagaaagagcactgcaccaagagggaaagtgtgagagttgcgtgtataacatgatgggcaaacgggaaaagaaactaggcgagttcgggagggccaagggatcccgtgctatctggtacatgtggcttggtgcgcgatttctggaattcgaggccctcggcttcctgaacgaagatcattggtttgggcgcgagaatagctggtctggagtcgagggcgaaggtttgcacagactggggtatatcctcgaggaaattgacaagaaagatggagaccttatgtacgcagatgacacggctggctgggatacacggataaccgaggacgatctgcagaacgaggaattaatcactgagcagatggcccctcatcacaagattctggcaaaagccatcttcaagttgacatatcagaataaagttgtgaaggtactcaggcccaccccacgcggcgctgtgatggacattatctcgagaaaggatcaacgggggtcaggacaggtcggtacttacggcctgaacacctttacaaatatggaagtgcagctaataaggcagatggaggccgaaggggttatcacgcaagacgacatgcagaaccctaaaggacttaaggagcgagtggagaaatggctgcgtgaatgcggcgtcgatagactcaagcgcatggcgattagcggtgacgattgtgtggtaaaacccctggacgagcggttcgggacctccttgttatttctgaatgatatgggaaaggttaggaaagacatcccacagtgggaacccagtaagggctggaagaactggcaggaggtgcctttctgctctcatcactttcacaaaattttcatgaaggatggcagaagcctcgtcgtgccatgtcgcaatcaagacgaacttatcgggcgggcaaggatatcccagggagccggttggtcactgcgagagactgcttgcctaggcaaagcctacgcacagatgtggagtctgatgtattttcatagacgggatctcaggttggcttctatggccatttgtagcgctgttccgacagagtggttccccacctcccgcactacatggtcaatccacgcccatcaccagtggatgaccacggaagacatgctgaaggtgtggaaccgtgtctggatcgaggataatcctaacatgattgacaaaacaccagtgcacagctgggaagacataccctaccttgggaagagagaggatctgtggtgcggatctctcatcggcttatccagtcgagcaacctgggcgaagaatattcatactgccatcacccaagtaaggaacctgattggtaaagaagagtatgtggactacatgcctgtcatgaagcggtatagcgctccatcggagtccgaaggggttttgtga

SEQ ID NO: 15737 - RNA, 9867 nt, synthetic construct
  misc_feature 1..9867: note = derived and/or modified CDS sequence (opt3) from DENV-4__FJ639773__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaacgactgcgcatcaaaggtatgagctatacaatgtgcagtgggaagttctctatcgacaaagagatggctgagacgcaacacggcaccactgtcgtgaaggttaaatacgaaggagccggcgcaccttgtaaggtgccaattgagataagagatgtcaataaggaaaaagtggtagggagggtgatctccgccacacccttggctgagaacaccaacagcgttacaaatattgagctcgaaccgcctttcggagactcgtatatcgtcataggtgtgggcaactctgcgctgactttacattggtttcggaaggggtcctcaattggaaaaatgttcgagagtacctaccgcggcgcaaagagaatggccatcctgggtgaaacggcttgggattttgggagcgtgggcggactattcacctccctcggcaaagccgtccaccaggtttttgggtctgtgtatacaactatgttcggaggcgtgagctggatgatcaggattctgatcggttttcttgtattgtggattgggaccaattcacgtaacacaagtatggcaatgacttgcatagccgtcggaggcatcaccctgttcctcggttttacggtgcaggctgacatgggctgtgttgtgtcctggagcgggcgggagctgaagtgcggatctggcattttcgtcgtggataatgttcatacatggaccgaacaatacaagtttcagcccgagtcaccagcccgacttgcaagtgcgatcctgaacgctcacaaagacggggtgtgtggaatcagaagcactacaaggttggagaatgtaatgtggaagcagattaccaacgaactcaattatgtcctgtgggagggcggtcacgacttaactgtggtggccggggatgtcaaaggagttctgaccaagggcaaacgcgcactaacacctcccgcctccgacctcaagtactcttggaagacgtggggtaaagctaagatattcaccccagaagcccggaactcgacttttctgatcgatggccccgacacaagcgagtgccctaatgaaagaagggcatggaactccttcgaggtggaggattacgggttcggaatgtttaccacaaatatttggatgaaattccgcgaaggctcaagtgaggtatgtgaccatcgacttatgtctgctgccatcaaggatcagaaagcggtgcacgccgacatggggtattggattgaaagctccaagaaccaaacttggcagatcgagcgggcttcattgatagaagtcaaaacctgcctgtggccaaagacgcatacactctggagcaatggagtgctggagtctcagatgttaatcccgaagtcctacgcaggcccctttagtcagcacaactatcgtcaaggttacgccacccagactgttgggccttggcacctgggaaaacttgagattgatttcggcgaatgcccaggtaccacagtgactatccaggaggactgtgatcatagaggccccagcttgaggaccacaacggcttctgggaagctcgtcacccagtggtgctgtcgctcctgcactatgcctccactgcggtttctaggagaagacggctgttggtatgggatggagattagacccctgtcagagaaagaagagaacatggtgaagagtcaagttacagccggacagggcaccagcgaaactttctcgatgggtctcctgtgccttacattgtttgtggaggaatgtctgaggcgacgcgtcacccggaaacacatgatcttagcagtagtgataacgctctgcgcgattatcctggggggacttacttggatggatctgttgagagccctcattatgctgggcgacaccatgtccggcaggatcgggggacagacacatctagctataatggccgttttcaagatgtctccgggttacgtgctgggcgtctttctccgtaagctgaccagccgcgagactgcacttatggtgatcgggatggctatgacaaccacattgtcaattcctcacgacctgatggagttaatcgatggaattagtctcggcctgatccttctgaaaatagtaactcagttcgacaatacccaagtgggtacgctagccctctccctgacatttattcggtctaccatgagcttggtcatggcatggagaactatcatggccgttctgttcgtggtgaccttaatcccactctgtaggacatcctgcctgcagaagcagtcacattgggtcgaaattactgctcttatcctgggggcgcaagccttgcccgtgtatctcatgaccctgatgaaaggagcaagccgacggagttggcctctaaacgagggcattatggctgttggcctggtatctcttctcgggtccgccctgttgaagaatgatgtgcccctggccggaccaatggtcgctggtggcttactcctggcagcctacgtgatgagcgggtcgtcagcggacctttctctggaaaaagctgccaacgttcagtgggatgagatggcagacataacgggaagttcccctatcattgaagtgaagcaggatgaggacggcagcttttctatccgcgatgtcgaggaaacaaatatgattaccttgctcgtgaagctggccctaatcactgtaagcggtctgtacccccttgctataccagtcacaatgaccctctggtatatgtggcaggtgaaaactcaaagatccggggcactgtgggacgttccgtcacctgccacaacccagaaggcggctttgagtgagggagtgtacaggatcatgcagcggggcttattcggcaaaacgcaggtcggggtgggaattcacatggaaggtgttttccacactatgtggcatgtgacccgaggcagcgtcatctgtcacgagacagggagactggaaccctcttgggccgatgtgcgcaacgacatgatttcctatggaggcggttggaggctcggggataagtgggacaaagaggaggacgtacaagtgctggcaatcgaaccaggaaagaatcccaagcatgttcagaccaaacctggcctttttaagacactgactggcgagataggggccgtcaccttggatttcaaaccaggaacgtcaggtagtcccattatcaaccgtaagggcaaagtgatcgggctatacggaaatggcgtggtcacaaagagcggtgactatgtatccgctattactcaggccgaacggataggggagcctgattacgaggtggacgaagatatctttagaaaaaagaggctgaccattatggacctccacccgggagcaggcaagacaaaacgcatcctgccatctattgttcgagaggctcttaagagacggttaaggaccctgatcctcgcccccactcgcgtggtcgcggccgaaatggaggaagcattgcgtggcctgcctataagatatcagaccccagctgtgaaatcggagcatacagggcgggagatcgttgatctcatgtgccacgccacgttcactaccaggctgcttagctcaacacgcgtgcccaactacaatctgattgtcatggacgaagctcactttaccgatccttccagtgtggcagcccgaggatacatctctactagagtagagatgggtgaagccgctgcgattttcatgacagcaaccccgcccggcgccacggacccatttcctcaaagcaactcccccatcgaggatatagaacgggagattccagagaggtcatggaatactgggttcgactggatcacagactatcagggaaagaccgtgtggtttgttccttctatcaaagctggcaacgatattgccaattgcttgcgcaagagcggtaagaaagtcatccagctaagtagaaagaccttcgacactgaataccccaaaacaaagctgaccgattgggactttgtggtgacaactgatatatccgagatgggggcaaacttcagggccggccgggtcattgacccacgtcgctgtctcaaaccggttatcttaacggatggacctgaacgagtgattctggctggccccatcccagtaacccccgcgagcgccgcacaaagaagggggcggataggacgcaaccctgctcaggaggacgatcagtatgtgttctctggtgacccacttaagaatgatgaagaccatgcccactggacagaggcaaagatgctgctcgataacatttacactcccgagggcatcatccctaccttgtttgggccggaaagagagaaaacacaggccattgacggagaattcaggctgcggggcgagcaacgaaagacctttgtcgagctcatgagacgcggtgacctgccagtgtggctttcatataaagttgcttccgccgggatcagttacaaggatagggaatggtgcttcactggcgagcggaataaccagattctagaagagaatatggaagtggagatatggacgcgtgagggagaaaaaaagaagctgagacccaaatggttggacgcgagggtctatgcagatcctatggccttaaaggactttaaagagttcgctagcggccgcaagtcgatcaccctggatattctcacagaaatcgcctctctgcccacttacctttccagccgggctaaactggcactcgacaacatcgtaatgttgcataccacagagcgagggggaagagcctaccagcacgctctgaatgaactaccagagtcactggagaccctcatgcttgtggccctgttaggtgcaatgactgcgggcatttttttgttctttatgcaggggaagggaataggcaagctgagtatgggtctcatcacaattgccgttgcttctgggctgctttgggtggccgaaatccaacctcagtggattgcagcttccatcatactggagttctttctcatggtcttgctgatccccgaaccagagaaacagaggacgcctcaggataaccaattaatttatgtgatcctaaccattctgactatcataggcctcattgccgcaaatgaaatgggacttatcgagaagacaaaaaccgacttcggcttttaccaggagaagaccgaaacaactattctggatgtcgacttgcgcccggccagcgcttggacgctgtatgcggtggccaccacaatcctcactcccatgctgcggcacaccatagagaacacatcagcaaatcttagtctcgctgccatcgccaaccaggcagctgttctgatggggttgggaaaaggctggccactgcatagaatggatttaggtgtgcctctactggccatggggtgttacagccaggtaaatcccaccactctcacggcgtcccttgtgatgctgttggtccactatgctattatcggaccaggcctgcaagccaaggcaacacgtgaagcccagaaaaggaccgctgcaggtattatgaagaaccctactgttgacggcatcaccgtgatagatctcgagcccatttcttacgacccgaagttcgagaaacagctggggcaagtcatgcttttagtgctgtgcgccggacagctcttgctgatgcggacaacttgggcgttctgtgaagtactaaccctggctacaggcccaatcctcacgctttgggaggggaatcctggacgcttttggaacaccactatcgccgtgagcacagcaaacattttccgaggctcctatctggccggtgctgggttggccttttcactgatcaagaatgcacagacccccagaaggggaactggcacaaccggtgaaacgctcggcgagaaatggaagcggcagctgaactctttagaccgcaaagaattcgaggagtacaagagaagtgggatacttgaagttgataggaccgaggctaagtcggccctgaaagacggaagcaagattaaacatgcggtgtcccgaggctcttcaaagatccggtggattgtcgaacgtgggatggtgaaaccaaagggaaaggtcgtggatctcggctgcggtagagggggatggagctactatatggccacactaaaaaatgttactgaggtaaagggctacaccaaaggcgggcccggacacgaagagcctatcccgatggcaacatatggttggaacctggtgaagttgcattccggcgtcgacgtgttttacaaacccactgagcaagttgataccctgctctgtgacataggggaaagttctagcaatccaacaatcgaggaaggacgcacccttagggtgctgaagatggtcgagccttggttgtcatccaagcccgaattctgcattaaagtgctgaacccttatatgccaactgtaatcgaggagctcgaaaagttacagcggaaacacggcggtaatctggtgagatgtccccttagtcgcaacagcacgcacgagatgtactgggtttctggggcttccggaaatattgtctcaagcgtgaacacaacctcgaagatgctgctaaataggtttactacccgacatcggaaacctacatatgaaaaggatgtggacctcggcgccggcacgagatctgtcagtaccgagactgagaaaccagatatgacaatcattgggaggcgcctgcagcgtttgcaggaagagcacaaggaaacctggcattacgaccaagagaacccctaccggacttgggcatatcacggatcctacgaagctccgagcacaggttcagcctcctctatggttaatggcgtggtaaagctgctcaccaaaccttgggatgtgatcccaatggtcacacagcttgccatgactgacaccacgcccttcgggcagcagagagtgtttaaggagaaagttgacaccaggacacctcaaccaaagcccggaactcgcatggtgatgaccacaactgcgaactggctgtgggctttactgggcaaaaagaagaatccgcgattgtgcacccgggaggaattcataagcaaagtcagaagtaacgcagccattggtgctgtgtttcaggaggaacaggggtggacgtccgccagcgaggcagtaaatgattctaggttctgggaactcgttgacaaggagcgcgccctgcaccaagagggaaaatgtgaatcatgcgtgtataacatgatgggcaagagagagaaaaagctaggcgaatttgggcgggctaagggaagtagggcgatctggtacatgtggcttggtgcccgtttcctggagttcgaagcactcggctttctgaacgaggatcattggttcgggcgagagaattcctggagcggagtcgaaggcgagggtttgcaccgcctggggtatatcctcgaagagattgacaaaaaggatggagaccttatgtacgctgatgacacagccggctgggataccagaataactgaggacgatctgcagaacgaagagttaatcacagaacagatggcacctcatcacaaaattctggccaaggctatctttaaattgacctatcagaataaggtggtgaaggtcctccggcccactccaaggggcgccgttatggacattatctctcgcaaagatcaaagagggtcgggacaggtgggtacctacggcctgaacacattcacgaatatggaggtacagctaatacggcagatggaagcggagggggtgatcacccaagacgacatgcagaaccctaagggacttaaagagagggtcgaaaagtggctgcgagagtgcggcgtggatcgtctcaaaagaatggcaatttcaggtgacgattgtgttgtgaagcccctggacgaacgctttgggactagcttgttattcctgaatgatatgggaaaagtccggaaggacatcccacagtgggagccctccaagggctggaaaaactggcaggaagtgcctttttgcagtcatcacttccacaagatttttatgaaagatggcaggtctctcgtagttccatgtagaaatcaagacgagcttatcgggcgcgcccggataagccagggagctggttggtccctgagggagacagcctgcctaggcaaggcatacgctcagatgtggtcactgatgtatttccatcgaagagatctccggttggccagtatggctatttgttctgccgtgccgaccgaatggtttcccactagcaggacaacctggtccatccacgcacatcaccagtggatgacgacagaggacatgctgaaagtctggaaccgcgtgtggatcgaagataatcctaacatgattgacaagaccccagttcactcatgggaggacataccctaccttgggaagcgtgaagatctgtggtgcggaagcctcatcggcttatcttccagagcgacttgggccaaaaatattcataccgctatcacacaagtgcgaaacctgattggtaaggaggagtatgtcgactacatgcctgtgatgaaaaggtatagtgccccaagcgaatcggagggggtattgtga

SEQ ID NO: 15738 - RNA, 9867 nt, synthetic construct
  misc_feature 1..9867: note = derived and/or modified CDS sequence (opt3) from DENV-4__FJ882580__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaagagtggtagggagggtgatctccgccacacccttggctgagaacaccaacagcgttacaaatattgagctcgaaccgcctttcggagactcgtatatcgtcataggtgtgggcaactctgcgctgactttacattggtttcggaaggggtcctcaattggaaaaatgttcgagagtacctaccgcggcgcaaagagaatggccatcctgggtgaaacggcttgggattttgggagcgtgggcggactattcacctccctcggcaaagccgtccaccaggtttttgggtctgtgtatacaactatgttcggaggcgtgagctggatgatcaggattctgatcggttttcttgtattgtggattgggaccaattcacgtaacacaagtatggcaatgacttgcatagccgtcggaggcatcaccctgttcctcggttttacggtgcaggctgacatgggctgtgttgtgtcctggagcgggcgggagctgaagtgcggatctggcattttcgtcgtggataatgttcatacatggaccgaacaatacaagtttcagcccgagtcaccagcccgacttgcaagtgcgatcctgaacgctcacaaagacggggtgtgtggaatcagaagcactacaaggttggagaatgtaatgtggaagcagattaccaacgaactcaattatgtcctgtgggagggcggtcacgacttaactatagtggccggggatgtgaaaggagtcctgaccaagggcaaacgcgcactaacacctcccgcctccgacctcaagtactcttggaagacgtggggtaaagctaagatcttcaccccagaagcccggaactcgacttttctgattgatggccccgacacaagcgagtgccctaatgaaagaagggcatggaactccttcgaggttgaggattacgggttcggaatgtttaccacaaatatctggatgaaattccgcgaaggctcaagtgaggtgtgtgaccatcgacttatgtctgctgccattaaggatcagaaagcggtacacgccgacatggggtattggatcgaaagctccaagaaccaaacttggcagatagagcgggcttcattgatcgaagtgaaaacctgcctgtggccaaagacgcatacactctggagcaatggagtcctggagtctcagatgttaattccgaagtcctacgcaggcccctttagtcagcacaactatcgtcaaggttacgccacccagactgtggggccttggcacctgggaaaacttgagatcgatttcggcgaatgcccaggtaccacagttactattcaggagaactgtgaccatagaggccccagcttgaggaccacaacggcttctgggaagctcgtgacccagtggtgctgtcgctcctgcactatgcctccactgcggtttctaggagaagatggctgttggtatgggatggagatcagacccctgtcagagaaagaagagaatatggtcaagagtcaagtgacagccggacagggcaccagcgaaactttctcgatgggtctcctgtgccttacattgtttgttgaggaatgtctgaggcgacgcgtgacccggaaacacatgatattagcagtcgtaattacgctctgcgcgatcattctggggggacttacttggatggacctgttgagagccctcatcatgctgggcgataccatgtccggcaggatagggggacagacacatctagctatcatggccgtgttcaagatgtctccgggttacgttctgggcgtgtttctccgtaagctgaccagccgcgagactgcacttatggtcattgggatggctatgacaaccacattgtcaatccctcacgacctgatggagttaattgacggaatcagtctcggcctgatacttctgaaaattgtgactcagttcgataacacccaagtaggtacgctagccctctccctgacatttatccggtctaccatgagcttggtgatggcatggagaactatcatggccgtcctgttcgttgtgaccttaattccactctgtaggacatcctgcctgcagaagcagtcacattgggtggaaatcactgctcttattctgggggcgcaagccttgcccgtctatctcatgaccctgatgaaaggagcaagccgacggagttggcctctaaatgagggcataatggctgtgggcctggtttctcttctcgggtccgccctgttgaagaacgacgtacccctggccggaccaatggtggctggtggcttactcctggcagcctacgtcatgagcgggtcgtcagcggatctttctctggaaaaagctgccaatgtgcagtgggacgagatggcagatatcacgggaagttcccctattatcgaagttaagcaggacgaggatggcagcttttctattcgcgacgtggaggaaacaaacatgatcaccttgctcgtcaagctggccctaataactgtgagcggtctgtacccccttgctatcccaattacaatgaccctctggtatatgtggcaggtaaaaactcaaagatccggggcactgtgggatgtcccgtcacctgccgcgacacagaaggctgccttgagtgagggagtgtacaggatcatgcagcggggcttattcggcaaaacccaggttggggtgggaattcacatggaaggtgtcttccacacgatgtggcatgtgactcgaggcagcgttatctgtcacgagaccgggagactggaaccctcttgggcagacgtgcgcaatgatatgatatcctatggaggcggttggaggctcggggacaagtgggataaagaggaggacgtccaagtgctggccattgaaccaggaaagaaccccaagcatgtacagacaaaacctggcctttttaagaccctgacaggcgagatcggggctgtgactttggacttcaaaccaggaacctcaggtagtcccatcattaatcgtaagggcaaagttatagggctatacggaaacggcgtcgtgacgaagagcggtgattatgtgtccgccatcacacaggcagaacggattggggagcctgactacgaggtcgatgaagacatctttagaaaaaagaggctgactattatggatctccacccgggagctggcaagaccaaacgcatcctgccatctatagtacgagaggcccttaagagacggttaaggacactgatcctcgcgcccacccgcgtggttgccgcagaaatggaggaagctttgcgtggcctgcctattagatatcagactccagccgtgaaatcggagcataccgggcgggagatcgtcgacctcatgtgccacgctacattcacgactaggctgcttagctcaacccgcgtgcccaattacaacctgattgttatggatgaagcacactttacagacccttccagtgtggccgcccgaggatacatctctaccagagtcgagatgggtgaagctgcggcaatattcatgactgccacaccgcccggcgctaccgatccatttcctcaaagcaattcccccattgaggacatcgaacgggagatcccagagaggtcatggaacacggggttcgattggattactgactatcagggaaagacagtgtggtttgtaccttctatcaaagccggcaatgacatagcaaactgcttgcgcaagagcggtaagaaagtgattcagctaagtagaaagaccttcgataccgaataccccaaaactaagctgacagactgggattttgttgtcaccacagacatctccgagatgggggccaacttcagggctggccgggtgattgatccacgtcgctgtctcaaaccggtgatcttaactgacggacctgaacgagtcatactggcgggccccattccagttacgcccgccagcgcagctcaaagaagggggcggatcggacgcaatcctgcccaggaggatgaccagtatgtgttctctggtgatccacttaagaacgacgaagatcatgcacactggaccgaggccaagatgctgctcgacaatatctacacacccgagggcattatccctactttgtttgggccggaaagagagaaaacccaggctattgatggagaattcaggctgcggggcgagcaacgaaagacatttgtagagctcatgagacgcggtgacctgccagtgtggctttcatataaagtcgcctccgcggggataagttacaaggacagggaatggtgcttcaccggcgagcggaacaatcagatcctagaagagaacatggaagtggagatttggactcgtgagggagaaaaaaagaagctgagacccaaatggttggatgcaagggtttatgccgaccctatggctttaaaggattttaaagagttcgccagcggccgcaagtcgatcacgctggacatcctcaccgaaattgcttctctgcccacatacctttccagccgggcaaaactggccctcgataatatagtgatgttgcatactaccgagcgagggggaagagcttaccagcacgccctgaacgaactaccagagtcactggagacactcatgcttgtcgcactgttaggtgcgatgaccgccggcatctttttgttctttatgcaggggaagggaattggcaagctgagtatgggtctcatcactattgctgtagcctctgggctgctttgggtggcagaaatccaacctcagtggatagctgcctccatcattctggagttctttctcatggttttgctgatccccgaaccagagaaacagaggacacctcaggacaatcaattaatttatgtgatcctaacgatactgaccattatcggcctcattgcagccaacgaaatgggacttatcgagaagactaaaacagatttcggcttttaccaggtcaagaccgagaccacaatactggacgtggatttgcgcccggctagcgcgtggactctgtatgccgtcgcaacgaccatcctcacacccatgctgcggcacactattgaaaatacctcagctaaccttagtctcgccgccatcgcaaatcaggctgccgtgctgatggggttgggaaaaggctggccactgcatagaatggacttaggtgttcctctactggcgatggggtgttacagccaggtgaaccccacaaccctcactgcttcccttgtaatgctgttggtgcactatgccattatcggaccaggcctgcaagcaaaggccacgcgtgaggctcagaaaaggacagcagccggtataatgaagaatcctaccgtcgatggcattactgttatcgacctcgaacccatctcttacgatccgaagttcgagaaacagctggggcaagtgatgcttttagtcctgtgcgcgggacagctcttgctgatgcggaccacatgggctttctgtgaggtgctaactctggccaccggcccaattctcacactttgggaagggaaccctggacgcttttggaacacgaccatcgcagtaagcactgccaatatattccgaggctcctatctggctggtgccgggttggcattttcactgattaagaacgctcagacacccagaaggggaaccggcactacaggtgagaccctcggcgaaaaatggaagcggcagctgaattctttagaccgcaaagagttcgaagagtacaagagaagtgggatccttgaggtggacaggacggaagccaagtcggcgctgaaagatggaagcaagattaaacatgccgtttcccgaggctcttcaaagatccggtggatagtggagcgtgggatggtcaaaccaaagggaaaggtggtcgacctcggctgcggtagagggggatggagctactatatggcaaccctaaaaaacgtgacagaagttaagggctacactaaaggcgggcccggacacgaggaacctatcccgatggctacctatggttggaatctggtaaagttgcattccggcgtggatgtcttttacaaacccacagagcaagtggacactctgctctgtgatattggggagagttctagcaacccaaccatcgaagagggacgcacacttagggttctgaagatggtggaaccttggttgtcatccaagcccgagttctgcattaaagtcctgaatccttatatgccaaccgtgatcgaagagctcgagaagttacagcggaaacacggcggtaacctggtaagatgtccccttagtcgcaatagcactcacgaaatgtactgggtgtctggggcctccggaaacattgtttcaagcgtcaatacgacatcgaagatgctgctaaacaggtttaccactcgacatcggaaacctacctatgagaaggacgtggatctcggcgcaggcacaagatctgtgagtacggaaaccgagaaaccagacatgactatcatagggaggcgcctgcagcgtttgcaggaggaacacaaggagacatggcattacgatcaagaaaatccctaccggacctgggcttatcacggatcctacgaggccccgagcactggttcagcctcctctatggtcaacggcgttgtgaagctgctcacaaaaccttgggacgtaattccaatggtgacccagcttgcgatgacagatactacccccttcgggcagcagagagtctttaaggaaaaagtggacacgaggacccctcaaccaaagcccggaacacgcatggttatgactaccacagctaattggctgtgggcattactgggcaaaaagaagaacccgcgattgtgcactcgggaggagttcatcagcaaagtgagaagtaatgccgctatcggtgccgtctttcaggaagagcaggggtggacctccgcaagcgaagccgtgaacgactctaggttctgggagctcgtagataaggaacgcgctctgcaccaagagggaaaatgtgagtcatgcgtttataacatgatgggcaagagagaaaaaaagctaggcgagtttgggcgggcgaagggaagtagggccatttggtacatgtggcttggtgcacgtttcctggaattcgaggctctcggctttctgaatgaagaccattggttcgggcgagagaactcctggagcggagtggagggcgaaggtttgcaccgcctggggtatatactcgaggaaatcgataaaaaggacggagatcttatgtacgccgacgatacggcaggctgggacacaagaattaccgaggatgacctgcagaatgaggaattaatcactgagcagatggcccctcatcacaaaattctggctaaggccatctttaaattgacatatcagaacaaggtcgtgaaggtgctccggcccaccccaaggggcgcggtcatggatataatctctcgcaaagaccaaagagggtcgggacaggttggtacttacggcctgaataccttcacaaacatggaagtgcagctaattcggcagatggaggcagaaggggtaatcacgcaagatgacatgcagaatcctaagggacttaaagagagggtggagaagtggctgcgagaatgcggcgtcgaccgtctcaaaagaatggccatttcaggtgatgactgtgtggttaagcccctggatgagcgctttgggaccagcttgttattcctgaacgacatgggaaaagtgcggaaggatatcccacagtgggaaccctccaagggctggaaaaattggcaggaggtccctttttgcagtcatcacttccacaagatatttatgaaagacggcaggtctctcgtggtaccatgtagaaaccaagatgaacttattgggcgcgctcggatcagccagggagccggttggtccctgagggagactgcatgcctaggcaaggcttacgcccagatgtggtcactgatgtatttccatcgaagagacctccggttggctagtatggccatctgttctgcagttccgacagagtggtttcccaccagcaggactacatggtccattcacgcgcatcaccagtggatgaccacggaagatatgctgaaagtgtggaatcgcgtctggatagaggacaaccctaatatgatcgataagacaccagtgcactcatgggaagacattccctaccttgggaagcgtgaggacctgtggtgcggaagcctcatcggcttatcttccagagccacctgggctaaaaacattcatactgccatcacccaagttcgaaatctgataggtaaggaagagtatgtggattacatgcctgtcatgaaaaggtatagtgcaccaagcgagtcggaaggggtgttgtga

SEQ ID NO: 15739 - RNA, 9867 nt, synthetic construct
  misc_feature 1..9867: note = derived and/or modified CDS sequence (opt3) from DENV-4__FJ882581__SS-prME
  source 1..9867: mol_type = other RNA
agcaccataaccctgctctgccttattcccactgtgatggccttccacctgtccacgcgggacggcgaacctttgatgatagtcgctaagcatgaaagggggcggccattactgtttaaaaccaccgaaggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcaggattctgatcggttttcttgtattgtggattgggaccaattcaagaaacacaagtatggcaatgacttgcatagccgtcggaggcatcaccctgttcctcggttttacggtgcaggctgacatgggctgtgttgtgtcctggaatgggcgtgagctgaagtgcggaagcggcattttcgtcgtggataacgttcatacatggaccgaacaatacaaatttcagcccgagtctccagcccggcttgcatcagcgatcctgaatgctcacaaggacggggtgtgtggaatccgaagtactacaagattggagaacgtaatgtggaaacagattaccaatgaactcaactatgtcctgtgggagggcggtcacgacttaactgtggtggccggggatgtcaagggagttctgaccaaaggcaagagggcactaacacctcccgccagcgacctcaagtactcctggaaaacgtggggtaaggctaaaatattcaccccagaagcccgcaattctacttttctgatcgatggccccgacacatcggagtgccctaacgaacggagagcatggaatagcttcgaggtggaggattacgggttcggaatgtttaccacaaacatttggatgaagttcagggaaggctcctcagaggtatgtgaccatcgccttatgagtgctgccatcaaagatcagaaggcggtgcacgccgacatggggtattggattgaatctagcaaaaatcaaacttggcagatcgagcgagcttccttgatagaagtcaagacctgcctgtggccaaagacgcatacactctggtcaaacggagtgctggagagccagatgttaatcccgaaatcttacgcaggccccttttcccagcacaactatcggcaaggttacgccacccagactgttgggccttggcacctgggaaaacttgagattgatttcggcgaatgcccaggtaccacagtgactatccaggagaattgtgaccatcgtggccccagtttgagaaccacaacggctagcgggaaactcgtcacccagtggtgctgtaggtcttgcactatgcctccactgcgctttctaggagaagatggctgttggtatgggatggagattcggcccctgtccgagaaggaagagaacatggtgaaatcacaagttacagccggacagggcaccagtgaaactttcagcatgggtctcctgtgccttacattgtttgtggaggaatgtctgagaaggcgagtcacccgcaagcacatgatcttagcagtagtgataacgctctgcgcgattatcctagggggccttacttggatggacctgttgcgggccctcattatgctgggcgataccatgtcgggcagaatcgggggacagacacatctagctataatggccgttttcaagatgtccccgggttacgtgctgggcgtctttctcaggaaactgacctctcgtgagactgcacttatggtgatcgggatggctatgacaaccacattgagcattcctcacgacctgatggagttaatcgacggaatttcactcggcctgatccttctgaagatagtaactcagttcgataatacccaagtgggtacgctagccctcagtctgacatttattcgctccaccatgtctttggtcatggcatggcggactatcatggccgttctgttcgtggtgaccttaatcccactctgtagaacaagctgcctgcagaaacagtcccattgggtcgaaattactgctcttatcctgggggcgcaagccttgcccgtgtatctcatgaccctgatgaagggagcatcaaggcgaagctggcctctaaacgagggcattatggctgttggcctggtaagtcttctcgggtctgccctgttgaaaaatgacgtgcccctggccggaccaatggtcgctggtggcttactcctggcagcctacgtgatgtccgggagctcggcggatctttcactggaaaaggctgccaacgttcagtgggacgagatggcagatataacgggatctagtcctatcattgaagtgaagcaggacgaggatggctcctttagcatccgggacgtcgaggaaacaaatatgattaccttgctcgtgaaactggccctaatcactgtatctggtctgtacccccttgctataccaatcacaatgaccctctggtatatgtggcaggtcaagactcaacgcagcggggcactgtgggatgtgccgtcccctgccgcgacacagaaagctgccttgtcagagggagtttacagaattatgcagaggggcttattcggcaagacccaggtgggggtcggaatccacatggaaggtgtgttccacacgatgtggcatgttactcggggcagtgtgatttgtcacgagaccgggcgactggaacccagctgggcagacgtcagaaacgatatgatctcttatggaggcggttggcgcctcggggacaaatgggataaggaggaggacgtgcaagtactggccatagaaccaggaaagaatcccaaacatgtgcagacaaagcctggcctttttaaaaccctgacaggcgagattggggctgttactttggacttcaagccaggaacctccggttcacccatcatcaacaggaaaggcaaggtcattgggctatacggaaatggcgtggtgacgaaaagtggtgattatgtcagcgccataacacaggcagaacgtatcggggagcctgactacgaggtagatgaagacatttttcggaagaagagactgactatcatggatctccacccgggagctggcaaaaccaagaggattctgccatccatcgtgcgcgaggcccttaaacgaagattacggacactgatactcgcgcccaccagggttgtggccgcagaaatggaggaggctttgcgcggcctgcctatccgttatcagactccagccgtcaagtctgagcataccgggagagagattgtggacctcatgtgccacgctacattcacgactcggctgctttcgagcaccagggttcccaactacaatctgatcgtgatggatgaagcacactttacagacccttcatccgtcgccgcccgcggatacattagtacccgagtggagatgggtgaagctgcggcaatcttcatgactgccacaccgcccggcgctaccgatccatttcctcaatctaacagccccatagaggacattgaaagagagatcccagagcggtcctggaatacggggttcgattggatcactgactatcagggaaaaacagtatggtttgtgccttcaattaaggccggcaacgacatcgcaaactgcttgaggaagtctggtaaaaaggttatacagctaagccgcaaaaccttcgataccgaataccccaagactaaactgacagactgggattttgtcgtgaccacagacattagtgagatgggggccaatttcagagctggcagggtgatcgatccacggcgttgtctcaagccggtcattttaactgacggacctgaacgcgttatcctggcgggccccataccagtgacgcccgcctccgcagctcaacgaagagggaggattggacggaaccttgcccaggaggatgaccagtatgtattcagcggtgatcctctgaagaatgacgaagatcatgcacactggaccgaggccaaaatgctcttggacaacatctacacaccagagggcatcattcccactctgtttgggcctgaacgcgagaagacccaggctatcgatggagagttcagactcaggggcgagcaacggaaaacatttgtggagctgatgcgaagaggtgaccttccggtctggctatcttataaggtggcctcagcggggatttcctacaaagaccgcgaatggtgcttcaccggcgagaggaataaccagatactggaagagaatatggaagttgagatctggactcgggagggagaaaagaagaaattgcgtccaaagtggttagatgcaagagtgtatgccgaccccatggctctgaaagattttaaggagttcgccagtggcaggaaaagcattacgctcgacatcctgaccgaaatcgcttcgcttcctacatacctgtcttcccgcgcaaagctcgccttggataacattgtcatgctgcatactaccgagagagggggacgagcttaccagcacgccctaaatgaactgcccgagagcctcgagacacttatgctggtagcattattgggtgcgatgaccgccggcatatttctgttctttatgcaggggaagggaatcggcaaactctcaatgggtctgattactatcgctgtggccagtgggcttctgtgggttgcagaaattcaaccacagtggatcgctgcctctataatcctcgagttctttttgatggtgctgttaattcctgaacccgagaagcagagaacaccacaggacaaccaactaatctatgtcattctgacgatcctcaccataattggccttatcgcagccaatgaaatgggactgattgagaaaactaagacagatttcggcttttaccaggtgaaaaccgagaccacaatcttggacgtcgatctgaggcctgcttccgcgtggactctctatgccgtggcaacgaccatactgacaccgatgcttcgccacactatcgaaaacaccagcgctaatctctcactggccgccattgcaaaccaggctgccgttttgatggggctgggaaagggctggcccttacatcggatggacctaggtgtgccactgctcgcgatggggtgttacagtcaggtaaatcctacaacccttactgctagcctggtgatgttgctggtccactatgccatcattggacccggcctccaagcaaaagccacgagagaggctcagaagcgtacagcagccggtatcatgaagaacccaaccgttgatggcataactgtgattgacctggaacctatctcctacgatcccaaattcgagaagcagcttgggcaagtcatgttactggtgctctgcgcgggacagttgctgctaatgaggaccacatgggctttctgtgaggtactgactctcgccaccggcccgatccttacactgtgggaagggaacccaggacggttttggaatacgaccattgcagtgtctactgccaacatcttccgcggcagctatttggctggtgccgggctggcattttccctcatcaagaatgctcagacacctcgaagaggaaccggcactacaggtgagaccctgggcgaaaagtggaaaaggcagttaaactcacttgaccggaaggagttcgaagagtacaagcgctctgggattctggaggttgacagaacggaagccaaaagtgcgctcaaggatggatcgaaaatcaagcatgccgtgagcaggggctcctctaaaattcgatggatcgtcgagcgggggatggtgaagcccaagggaaaagtcgtggacctaggctgcggtcgtgggggatggtcatactatatggcaaccctgaagaatgttacagaagtaaaaggctacactaagggcgggccaggacacgaggaacccatacctatggctacctatggttggaacttggtgaaactgcatagcggcgtcgatgtgttttacaagccgacagagcaagttgacactctcctttgtgatatcggggagtccagttctaatcccaccattgaagagggaagaacactgcgcgtgttgaagatggtcgaaccatggctgagctcaaaacctgagttctgcatcaaggtgctcaacccctatatgcctaccgtaattgaagagttagagaaactgcagaggaagcacggcggtaatcttgtgcggtgtccactgtccagaaacagtactcacgaaatgtactgggttagcggggcctctggaaatatcgtctcctcagtgaacacgacaagcaaaatgctactcaatcgctttaccactaggcatcgaaagcccacctatgagaaagacgtggatctgggcgcaggcacacggtcggtctctacggaaaccgagaagcctgacatgactattatcgggagaaggttgcagcgcctgcaggaggaacacaaggagacatggcattacgatcaagaaaacccataccgtacctgggcttatcacggaagttacgaggccccctccactggtagcgcctcatccatggttaatggcgtggtaaaactccttacaaagccgtgggacgtgatacctatggtcacccagctggcgatgacagatactaccccattcgggcagcagcgggtgtttaaagaaaaggttgacacgagaacaccccaacctaaaccaggaacaaggatggtgatgactaccacagctaactggttatgggcactgttgggcaagaagaaaaatccccgcctctgcactcgagaggagttcatttctaaggtccggagcaacgccgctatcggtgccgtgtttcaggaagaacaggggtggaccagtgcatccgaagccgtaaacgacagcagattctgggagctggttgataaagaaagggctctacaccaagagggaaagtgtgagtcttgcgtgtataatatgatgggcaaacgcgaaaagaaacttggcgagtttgggagagcgaaaggatcacgggccatctggtacatgtggctgggtgcaaggttcctcgagttcgaggctctgggctttttgaacgaagaccattggttcgggcgtgagaatagttggtccggagtcgagggcgaaggtctgcaccgactcgggtatattcttgaggaaatagataagaaagacggagatctgatgtacgccgacgatacggcaggctgggacacacgcatcaccgaggatgacttacagaacgaggaactgattactgagcagatggccccgcatcacaagatcttggctaaagccatttttaagctcacatatcagaataaggtggtgaaagtcctgagacctacaccccggggcgcggttatggatatcataagcaggaaggaccaacgcgggtctggacaggtgggtacttacggcctaaacaccttcacaaatatggaagtacagcttatcagacagatggaggcagaaggggtgattacgcaagatgacatgcagaacccaaaaggactgaaggagcgggtcgagaaatggctcagggaatgcggcgtggaccgactgaagcgtatggccatctcgggtgatgactgtgttgtgaaacctttggatgagagatttgggacctcattactgttcctcaatgacatgggaaaggtccgcaaggatattccccagtgggaaccaagcaaaggctggaagaactggcaggaggtgcccttttgctcccatcacttccacaaaatctttatgaaggacggccggagtcttgtagttccttgtaggaatcaagatgaactgatagggagagctcgcatttctcagggagccggttggagcctacgggagactgcatgcctgggcaaggcttacgcccagatgtggtccctcatgtatttccataggcgagacttgagactggcttcaatggccatctgtagtgcagtgccaacagagtggtttccgacctctcggactacatggagcatccacgcgcatcaccagtggatgaccacggaagatatgcttaaggtctggaacagggtgtggattgaggacaatcccaacatgatagataagacacctgttcactcctgggaagacatcccatacctggggaaacgcgaggacctctggtgcggatcattaattggcctgagctctcgtgccacctgggctaagaatatccatactgccattacccaagtgagaaacttgatcggtaaagaagagtatgtcgattacatgcccgtgatgaagcgatattccgcacctagtgagagcgaaggggtactgtga

SEQ ID NO: 15740 - RNA, 9867 nt, synthetic construct
  misc_feature 1..9867: note = derived and/or modified CDS sequence (opt3) from DENV-4__FJ882582__SS-prME
  source 1..9867: mol_type = other RNA
agcaccataaccctgctctgccttattcccactgtgatggccttccacctgtccacgcgggacggcgaacctttgatgatagtcgctaagcatgaaagggggcggccattactgtttaaaaccaccgaaggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcaggattctgatcggttttcttgtattgtggattgggaccaattcaagaaacacaagtatggcaatgacttgcatagccgtcggaggcatcaccctgttcctcggttttacggtgcaggctgacatgggctgtgttgtgtcctggaatgggcgtgagctgaagtgcggaagcggcattttcgtcgtggataacgttcatacatggaccgaacaatacaaatttcagcccgagtctccagcccggcttgcatcagcgatcctgaatgctcacaaggacggggtgtgtggaatccgaagtactacaagattggagaacgtaatgtggaaacagattaccaatgaactcaactatgtcctgtgggagggcggtcacgacttaactgtggtggccggggatgtcaagggagttctgaccaaaggcaagagggcactaacacctcccgccagcgacctcaagtactcctggaaaacgtggggtaaggctaaaatattcaccccagaagcccgcaattctacttttctgatcgatggccccgacacatcggagtgccctaacgaacggagagcatggaatagcttcgaggtggaggattacgggttcggaatgtttaccacaaacatttggatgaagttcagggaaggctcctcagaggtatgtgaccatcgccttatgagtgctgccatcaaagatcagaaggcggtgcacgccgacatggggtattggattgaatctagcaaaaatcaaacttggcagatcgagcgagcttccttgatagaagtcaagacctgcctgtggccaaagacgcatacactctggtcaaacggagtgctggagagccagatgttaatcccgaaatcttacgcaggccccttttcccagcacaactatcggcaaggttacgccacccagactgttgggccttggcacctgggaaaacttgagattgatttcggcgaatgcccaggtaccacagtgactatccaggagaattgtgaccatcgtggccccagtttgagaaccacaacggctagcgggaaactcgtcacccagtggtgctgtaggtcttgcactatgcctccactgcgctttctaggagaagatggctgttggtatgggatggagattcggcccctgtccgagaaggaagagaacatggtgaaatcacaagttacagccggacagggcaccagtgaaactttcagcatgggtctcctgtgccttacattgtttgtggaggaatgtctgagaaggcgagtcacccgcaagcacatgatcttagcagtagtgataacgctctgcgcgattatcctagggggccttacttggatggacctgttgcgggccctcattatgctgggcgataccatgtcgggcagaatcgggggacagacacatctagctataatggccgttttcaagatgtccccgggttacgtgctgggcgtctttctcaggaaactgacctctcgtgagactgcacttatggtgatcgggatggctatgacaaccacattgagcattcctcacgacctgatggagttaatcgacggaatttcactcggcctgatccttctgaagatagtaactcagttcgataatacccaagtgggtacgctagccctcagtctgacatttattcgctccaccatgtctttggtcatggcatggcggactatcatggccgttctgttcgtggtgaccttaatcccactctgtagaacaagctgcctgcagaaacagtcccattgggtcgaaattactgctcttatcctgggggcgcaagccttgcccgtgtatctcatgaccctgatgaagggagcatcaaggcgaagctggcctctaaacgagggcattatggctgttggcctggtaagtcttctcgggtctgccctgttgaaaaatgacgtgcccctggccggaccaatggtcgctggtggcttactcctggcagcctacgtgatgtccgggagctcggcggatctttcactggaaaaggctgccaacgttcagtgggacgagatggcagatataacgggatctagtcctatcattgaagtgaagcaggacgaggatggctcctttagcatccgggacgtcgaggaaacaaatatgattaccttgctcgtgaaactggccctaatcactgtatctggtctgtacccccttgctataccaatcacaatgaccctctggtatatgtggcaggtcaagactcaacgcagcggggcactgtgggatgtgccgtcccctgccgcgacacagaaagctgccttgtcagagggagtttacagaattatgcagaggggcttattcggcaagacccaggtgggggtcggaatccacatggaaggtgtgttccacacgatgtggcatgttactcggggcagtgtgatttgtcacgagaccgggcgactggaacccagctgggcagacgtcagaaacgatatgatctcttatggaggcggttggcgcctcggggacaaatgggataaggaggaggacgtgcaagtactggccatagaaccaggaaagaatcccaaacatgtgcagacaaagcctggcctttttaaaaccctgacaggcgagattggggctgttactttggacttcaagccaggaacctccggttcacccatcatcaacaggaaaggcaaggtcattgggctatacggaaatggcgtggtgacgaaaagtggtgattatgtcagcgccataacacaggcagaacgtatcggggagcctgactacgaggtagatgaagacatttttcggaagaagagactgactatcatggatctccacccgggagctggcaaaaccaagaggattctgccatccatcgtgcgcgaggcccttaaacgaagattacggacactgatactcgcgcccaccagggttgtggccgcagaaatggaggaggctttgcgcggcctgcctatccgttatcagactccagccgtcaagtctgagcataccgggagagagattgtggacctcatgtgccacgctacattcacgactcggctgctttcgagcaccagggttcccaactacaatctgatcgtgatggatgaagcacactttacagacccttcatccgtcgccgcccgcggatacattagtacccgagtggagatgggtgaagctgcggcaatcttcatgactgccacaccgcccggcgctaccgatccatttcctcaatctaacagccccatagaggacattgaaagagagatcccagagcggtcctggaatacggggttcgattggatcactgactatcagggaaaaacagtatggtttgtgccttcaattaaggccggcaacgacatcgcaaactgcttgaggaagtctggtaaaaaggttatacagctaagccgcaaaaccttcgataccgaataccccaagactaaactgacagactgggattttgtcgtgaccacagacattagtgagatgggggccaatttcagagctggcagggtgatcgatccacggcgttgtctcaagccggtcattttaactgacggacctgaacgcgttatcctggcgggccccataccagtgacgcccgcctccgcagctcaacgaagagggaggattggacggaaccttgcccaggaggatgaccagtatgtattcagcggtgatcctctgaagaatgacgaagatcatgcacactggaccgaggccaaaatgctcttggacaacatctacacaccagagggcatcattcccactctgtttgggcctgaacgcgagaagacccaggctatcgatggagagttcagactcaggggcgagcaacggaaaacatttgtggagctgatgcgaagaggtgaccttccggtctggctatcttataaggtggcctcagcggggatttcctacaaagaccgcgaatggtgcttcaccggcgagaggaataaccagatactggaagagaatatggaagttgagatctggactcgggagggagaaaagaagaaattgcgtccaaagtggttagatgcaagagtgtatgccgaccccatggctctgaaagattttaaggagttcgccagtggcaggaaaagcattacgctcgacatcctgaccgaaatcgcttcgcttcctacatacctgtcttcccgcgcaaagctcgccttggataacattgtcatgctgcatactaccgagagagggggacgagcttaccagcacgccctaaatgaactgcccgagagcctcgagacacttatgctggtagcattattgggtgcgatgaccgccggcatatttctgttctttatgcaggggaagggaatcggcaaactctcaatgggtctgattactatcgctgtggccagtgggcttctgtgggttgcagaaattcaaccacagtggatcgctgcctctataatcctcgagttctttttgatggtgctgttaattcctgaacccgagaagcagagaacaccacaggacaaccaactaatctatgtcattctgacgatcctcaccataattggccttatcgcagccaatgaaatgggactgattgagaaaactaagacagatttcggcttttaccaggtgaaaaccgagaccacaatcttggacgtcgatctgaggcctgcttccgcgtggactctctatgccgtggcaacgaccatactgacaccgatgcttcgccacactatcgaaaacaccagcgctaatctctcactggccgccattgcaaaccaggctgccgttttgatggggctgggaaagggctggcccttacatcggatggacctaggtgtgccactgctcgcgatggggtgttacagtcaggtaaatcctacaacccttactgctagcctggtgatgttgctggtccactatgccatcattggacccggcctccaagcaaaagccacgagagaggctcagaagcgtacagcagccggtatcatgaagaacccaaccgttgatggcataactgtgattgacctggaacctatctcctacgatcccaaattcgagaagcagcttgggcaagtcatgttactggtgctctgcgcgggacagttgctgctaatgaggaccacatgggctttctgtgaggtactgactctcgccaccggcccgatccttacactgtgggaagggaacccaggacggttttggaatacgaccattgcagtgtctactgccaacatcttccgcggcagctatttggctggtgccgggctggcattttccctcatcaagaatgctcagacacctcgaagaggaaccggcactacaggtgagaccctgggcgaaaagtggaaaaggcagttaaactcacttgaccggaaggagttcgaagagtacaagcgctctgggattctggaggttgacagaacggaagccaaaagtgcgctcaaggatggatcgaaaatcaagcatgccgtgagcaggggctcctctaaaattcgatggatcgtcgagcgggggatggtgaagcccaagggaaaagtcgtggacctaggctgcggtcgtgggggatggtcatactatatggcaaccctgaagaatgttacagaagtaaaaggctacactaagggcgggccaggacacgaggaacccatacctatggctacctatggttggaacttggtgaaactgcatagcggcgtcgatgtgttttacaagccgacagagcaagttgacactctcctttgtgatatcggggagtccagttctaatcccaccattgaagagggaagaacactgcgcgtgttgaagatggtcgaaccatggctgagctcaaaacctgagttctgcatcaaggtgctcaacccctatatgcctaccgtaattgaagagttagagaaactgcagaggaagcacggcggtaatcttgtgcggtgtccactgtccagaaacagtactcacgaaatgtactgggttagcggggcctctggaaatatcgtctcctcagtgaacacgacaagcaaaatgctactcaatcgctttaccactaggcatcgaaagcccacctatgagaaagacgtggatctgggcgcaggcacacggtcggtctctacggaaaccgagaagcctgacatgactattatcgggagaaggttgcagcgcctgcaggaggaacacaaggagacatggcattacgatcaagaaaacccataccgtacctgggcttatcacggaagttacgaggccccctccactggtagcgcctcatccatggttaatggcgtggtaaaactccttacaaagccgtgggacgtgatacctatggtcacccagctggcgatgacagatactaccccattcgggcagcagcgggtgtttaaagaaaaggttgacacgagaacaccccaacctaaaccaggaacaaggatggtgatgactaccacagctaactggttatgggcactgttgggcaagaagaaaaatccccgcctctgcactcgagaggagttcatttctaaggtccggagcaacgccgctatcggtgccgtgtttcaggaagaacaggggtggaccagtgcatccgaagccgtaaacgacagcagattctgggagctggttgataaagaaagggctctacaccaagagggaaagtgtgagtcttgcgtgtataatatgatgggcaaacgcgaaaagaaacttggcgagtttgggagagcgaaaggatcacgggccatctggtacatgtggctgggtgcaaggttcctcgagttcgaggctctgggctttttgaacgaagaccattggttcgggcgtgagaatagttggtccggagtcgagggcgaaggtctgcaccgactcgggtatattcttgaggaaatagataagaaagacggagatctgatgtacgccgacgatacggcaggctgggacacacgcatcaccgaggatgacttacagaacgaggaactgattactgagcagatggccccgcatcacaagatcttggctaaagccatttttaagctcacatatcagaataaggtggtgaaagtcctgagacctacaccccggggcgcggttatggatatcataagcaggaaggaccaacgcgggtctggacaggtgggtacttacggcctaaacaccttcacaaatatggaagtacagcttatcagacagatggaggcagaaggggtgattacgcaagatgacatgcagaacccaaaaggactgaaggagcgggtcgagaaatggctcagggaatgcggcgtggaccgactgaagcgtatggccatctcgggtgatgactgtgttgtgaaacctttggatgagagatttgggacctcattactgttcctcaatgacatgggaaaggtccgcaaggatattccccagtgggaaccaagcaaaggctggaagaactggcaggaggtgcccttttgctcccatcacttccacaaaatctttatgaaggacggccggagtcttgtagttccttgtaggaatcaagatgaactgatagggagagctcgcatttctcagggagccggttggagcctacgggagactgcatgcctgggcaaggcttacgcccagatgtggtccctcatgtatttccataggcgagacttgagactggcttcaatggccatctgtagtgcagtgccaacagagtggtttccgacctctcggactacatggagcatccacgcgcatcaccagtggatgaccacggaagatatgcttaaggtctggaacagggtgtggattgaggacaatcccaacatgatagataagacacctgttcactcctgggaagacatcccatacctggggaaacgcgaggacctctggtgcggatcattaattggcctgagctctcgtgccacctgggctaagaatatccatactgccattacccaagtgagaaacttgatcggtaaagaagagtatgcagattacatgcccgtcatgaagcgatattccgctcctagtgagagcgaaggggtgctgtga

SEQ ID NO: 15741 - RNA, 9867 nt, synthetic construct
  misc_feature 1..9867: note = derived and/or modified CDS sequence (opt3) from DENV-4__FJ882584__SS-prME
  source 1..9867: mol_type = other RNA
tcaaccataacactgctctgccttattcccactgtgatggccttccacctgtccacgcgggacggcgagcctttgatgatagtcgctaaacatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccactggggctgacacctctgaagtccactggaattacaaagagagaatggtgacattcaaggtcccccatgccaaaaggcaggatgtgaccgttctgggatcccaggaaggtgcgatgcactcagccctcgcaggcgctactgaggtggacagcggggatggaaaccacatgtttgccggccatctgaagtgtaaggtacggatggaaaaacttcgaatcaagggtatgagttatacaatgtgctctgggaaattctccatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatcagcgccacacccctggctgagaacaccaactcggttacaaatattgagttggaaccgcctttcggagactcttatatcgtcataggtgtgggcaactccgcgctcactctgcattggtttaggaaagggtcaagtattggaaagatgttcgagagcacctaccggggcgcaaaacgcatggccatcttaggtgaaacggcttgggattttgggtccgtgggcggactgttcacctctctaggcaaggccgtccaccaggtttttgggagcgtgtatacaactatgttcggaggcgtgtcatggatgatcaggattctcatcggttttctggtactttggattgggaccaatagtagaaacacatccatggcaatgacttgcatagccgtcggaggcatcaccttgttcctgggttttacggtgcaggctgacatgggctgtgttgtgagctggtctgggcgtgagctcaagtgcggatcaggcattttcgtcgtggataatgttcatacatggaccgaacaatacaaatttcagcccgagagtccagcccggctggcaagcgcgatccttaacgctcacaaggacggggtgtgtggaatccgatccactacaagactggagaatgtaatgtggaaacagattaccaacgaattgaattatgtcctctgggagggcggtcacgacctgactgtggtggccggggatgtcaagggagttttaaccaaaggcaagagggcactgacacctcccgcctctgacctaaagtactcgtggaaaacgtggggtaaggctaaaatattcaccccagaagcccgcaacagcacttttctcatcgatggccccgacacatccgagtgccctaatgaacggagagcatggaactcattcgaggtggaggattacgggttcggaatgtttaccacaaatatttggatgaagttcagggaaggcagttctgaggtatgtgaccatcgcctgatgagcgctgccatcaaagatcagaaggcggtgcacgccgacatggggtattggattgaatccagcaagaaccaaacttggcagatcgagcgagctagccttatagaagtcaagacctgcttgtggccaaagacgcatacactgtggtctaatggagtgctcgagtcccagatgctgatcccgaaaagttacgcaggcccctttagccagcacaactatcggcaaggttacgccacccagactgttgggccttggcacttaggaaagctggagattgatttcggcgaatgcccaggtaccacagtgactatccaggagaactgtgaccatcgtggcccctctcttagaaccacaacggcttccgggaaattggtcacccagtggtgctgtaggtcatgcactatgcctccactccgctttctgggagaagatggctgttggtatgggatggagattcggcccctaagtgagaaggaagagaatatggtgaaaagccaagttacagccggacagggcacctcggaaactttctccatgggtctgctctgcctgacactttttgtggaggaatgtttgagaaggcgagtcacccgcaagcacatgatcctggcagtagtgataacgttatgcgcgattatcctcgggggactgacttggatggaccttctgcgggccttgattatgctcggcgataccatgtctggcagaatcgggggacagacacatctggctataatggccgttttcaagatgagcccgggttacgtgctaggcgtctttctgaggaaactcacctcacgtgagactgcactgatggtgatcgggatggctatgacaaccacacttagtattcctcacgacttgatggagctgatcgacggaatttccttaggcctcatcctgcttaagatagtaactcagttcgataacacccaagtgggtacgctggccctatctctcacatttattcgcagcaccatgtccctggtcatggcatggcggactatcatggccgttttgttcgtggtgaccctgatcccattatgtagaacatcatgcctccagaaacagagccattgggtcgaaattactgctctgatccttggggcgcaagccctgcccgtgtatttgatgaccctcatgaagggagcaagtaggcgatcttggcctctgaatgagggcattatggctgttggcctagtatccctgcttgggagcgccctcctgaaaaacgacgtgcccttggccggaccaatggtcgctggtggcctgttactcgcagcctacgtgatgtcggggtcatctgcggatctgagtcttgaaaaggctgccaatgttcagtgggacgagatggcagatataacgggatccagccctatcattgaagtgaagcaggacgaggatggctcttttagcatccgggacgtcgaggaaacaaacatgattaccctgttggtgaaactcgccctgatcactgtatccggtctataccccctggctataccaatcacaatgaccctttggtatatgtggcaggtcaagactcaacgctcaggggcactctgggatgtgccgagtcctgccgcgacacagaaagctgccctgagcgagggagtttacagaattatgcagaggggcttgttcggcaagacccaggtgggggtcggaatccacatggaaggtgtgttccacacgatgtggcatgttactcggggctctgtgatttgtcacgagaccgggcgattagaaccctcctgggcagacgtcagaaatgatatgatctcatatggaggcggttggcgcctgggggacaaatgggataaggaggaggacgtgcaagtactcgccatagaaccaggaaagaaccccaaacatgtgcagacaaagcctggcctgtttaaaacccttacaggcgagattggggctgttactctggacttcaagccaggaaccagtggtagccccatcatcaataggaaaggcaaggtcattgggttgtacggaaacggcgtggtgacgaaatccggtgattatgtctctgccataacacaggcagaacgtatcggggagcctgactacgaggtagatgaagacatttttcggaagaagagactaactatcatggatctgcacccgggagctggcaaaaccaagaggattctcccatcgatcgtgcgcgaggccctgaaacgaagacttcggacattaatactggcgcccaccagggttgtggccgcagaaatggaggaagctctccgcggcttgcctatccgttatcagactccagccgtcaagagcgagcataccgggagagagattgtggacctgatgtgccacgctacattcacgactcggctcctgtcatccaccagggttcccaattacaaccttatcgtgatggatgaagcacactttacagaccctagttctgtcgccgcccgcggatacattagcacccgagtggagatgggtgaagctgcggcaatcttcatgactgccacaccgcccggcgctaccgatccatttcctcaatccaattcacccatagaggacattgaaagagagatcccagagcggtcttggaacacggggttcgattggatcactgactatcagggaaaaacagtatggtttgtgcctagcattaaggccggcaatgacatcgcaaactgcctgaggaagagtggtaaaaaggttatacagttgtcccgcaaaaccttcgataccgaataccccaagactaaactaacagactgggattttgtcgtgaccacagacattagcgagatgggggccaacttcagagctggcagggtgatcgatccacggcgttgtctgaagccggtcattctcactgacggacctgaacgcgttatcttagcgggccccataccagtgacgcccgcctctgcagctcaacgaagagggaggattggacggaatcctgcccaggaggatgaccagtatgtattctcaggtgatccactgaagaacgacgaagatcatgcacactggaccgaggccaaaatgcttctggacaatatctacacacccgagggcatcattcctactctctttgggccggaacgcgagaagacccaggctatcgatggagagttcagattgaggggcgagcaacggaaaacatttgtggagctgatgcgaagaggtgacctcccagtctggctgtcctataaggtggccagtgcggggattagctacaaagaccgcgaatggtgcttcaccggcgagaggaacaatcagatacttgaagagaacatggaagttgagatctggactcgggagggagaaaagaagaaactacgtcccaagtggctggatgcaagagtgtatgccgaccctatggctttgaaagattttaaggagttcgcctcgggcaggaaatctattacgttagacatcctgaccgaaatcgcttccctccccacatacctgagctcacgcgcaaaacttgccctggataatattgtcatgctccatactaccgagagagggggccgagcttaccagcacgccttgaacgaactgccagagagtctagagacactgatgctcgtagcacttctgggtgcgatgaccgccggcatatttttattctttatgcaggggaagggaatcggcaaattgtctatgggtctgattactatcgctgtggcctccgggctcctgtgggttgcagaaattcaacctcagtggatcgctgccagcataatccttgagttctttctgatggtgctcttgattcccgaaccagagaagcagagaacacctcaggacaatcaactgatctatgtcattttaacgatcctaaccataattggcctgatcgcagccaacgaaatgggactcattgagaaaactaagacagatttcggcttttaccaggtgaaaaccgagaccacaatccttgacgtcgatctgaggccggcttcagcgtggactttgtatgccgtggcaacgaccatactgacacccatgctccgccacactatcgaaaataccagtgctaacctgagccttgccgccattgcaaatcaggctgccgttctcatggggctgggaaagggctggccattgcatcggatggacctgggtgtgcctttactagcgatggggtgttactcccaggtaaaccccacaaccctgactgcttctctcgtgatgcttctggtccactatgccatcattggaccaggcttgcaagcaaaagccacgagagaggctcagaagcgtacagcagccggtatcatgaagaatcctaccgttgatggcataactgtgattgacctggaacccatcagctacgatccgaaattcgagaagcagctcgggcaagtcatgctgcttgtgttatgcgcgggacagctgctcttgatgaggaccacatgggctttctgtgaggtactgactctagccaccggcccaatcctgacactctgggaagggaaccctggacggttttggaacacgaccattgcagtgtccactgccaatatcttccgcggctcatatcttgctggtgccgggctggcattttctttgatcaaaaacgctcagacaccccgaagaggaaccggcactacaggtgagaccctgggcgaaaagtggaaaaggcagctcaatagtctggaccggaaggagttcgaagagtacaagcgctcggggattttagaggttgacagaacggaagccaaaagcgcgcttaaggatggatccaaaatcaagcatgccgtgtctaggggctcaagcaaaattcgatggatcgtcgagcgggggatggtgaagccaaagggaaaagtcgtggacctgggctgcggtcgtgggggatggtcctactatatggcaaccctcaagaacgttacagaagtaaaaggctacactaagggcgggcccggacacgaggaacctataccgatggctacctatggttggaatctagtgaaactgcatagtggcgtcgatgtgttttacaagcccacagagcaagttgacactttgctgtgtgatatcggggagtctagctcaaacccaaccattgaagagggaagaacactccgcgtgcttaagatggtcgaaccttggctgtccagtaaacccgagttctgcatcaaggtgttgaatccttatatgccaaccgtaattgaagaactggagaaactccagaggaagcacggcggtaacttagtgcggtgtcccctgagcagaaattctactcacgaaatgtactgggtttccggggcctcaggaaacatcgtcagctcggtgaatacgacatctaaaatgcttctgaaccgctttaccactaggcatcgaaagcctacctatgagaaagacgtggatctaggcgcaggcacacggagtgtctccacggaaaccgagaagccagacatgactattatcgggagaaggctccagcgcctgcaggaggaacacaaggagacatggcattacgatcaagaaaatccctaccgtacctgggcttatcacggaagctacgaggccccgtcaactggttccgcctctagcatggttaacggcgtggtaaaattgctgacaaagccttgggacgtgataccaatggtcacccagctcgcgatgacagatactacccccttcgggcagcagcgggtgtttaaagaaaaggttgacacgagaacccctcaaccaaaacccggaacaaggatggtgatgactaccacagctaattggctttgggcactgttaggcaagaagaaaaacccgcgcctgtgcactcgagaggagttcattagtaaggtccggtccaatgccgctatcggtgccgtgtttcaggaagaacaggggtggaccagcgcatctgaagccgtaaacgactcaagattctgggagttggttgataaagaaagggctctccaccaagagggaaagtgtgagagttgcgtgtataacatgatgggcaaacgcgaaaagaagctgggcgagtttgggagagcgaaaggatcccgggccatctggtacatgtggctaggtgcaaggttccttgagttcgaggctctgggctttctcaatgaagaccattggttcgggcgtgagaacagctggtctggagtcgagggcgaaggtctgcaccgattggggtatattctggaggaaatagataagaaagacggagatctcatgtacgccgacgatacggcaggctgggacacacgcatcaccgaggatgaccttcagaatgaggaactgattactgagcagatggcccctcatcacaagatcttagctaaagccatttttaagctgacatatcagaacaaggtggtgaaagtcttgagacccaccccacggggcgcggttatggatatcatatcgaggaaggaccaacgcgggtcaggacaggtgggtacttacggcctcaataccttcacaaacatggaagtacagctgatcagacagatggaggcagaaggggtgattacgcaagatgacatgcagaatcctaaaggactaaaggagcgggtcgagaaatggcttagggaatgcggcgtggaccgactgaagcgtatggccatcagcggtgatgactgtgttgtgaaacccctcgatgagagatttgggacctccctgttgttcttaaacgacatgggaaaggtccgcaaggatattccacagtgggaacccagtaaaggctggaagaattggcaggaggtgcctttttgctctcatcacttccacaaaatctttatgaaggacggccggagcctggtagttccatgtaggaaccaagatgaactcatagggagagctcgcatttcccagggagccggttggtcacttcgggagactgcatgcctgggcaaggcttacgcccagatgtggagtctaatgtatttccataggcgagacctgagactcgcttctatggccatctgtagcgcagtgccgacagagtggtttcccacctcccggactacatggtcaatccacgcgcatcaccagtggatgaccacggaagatatgttgaaggtctggaatagggtgtggattgaggacaaccctaatatgatagataagacaccagttcacagctgggaagacatcccctacctggggaaacgcgaggacctttggtgcggatctctgattggcctctccagtcgtgccacctgggctaagaacatccatactgccattacccaagtgagaaatttaatcggtaaagaagagtatgtcgattacatgcctgtgatgaagcgatatagcgcaccatcggagtccgaaggggtactgtga

SEQ ID NO: 15742 - RNA, 9867 nt, synthetic construct
  misc_feature 1..9867: note = derived and/or modified CDS sequence (opt3) from DENV-4__FJ882585__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgactattctggggggacttacctggatggacctgttgcgggccctcatcatgctgggcgatacaatgtccggcagaattgggggacagacccatctagctatcatggccgttttcaagatgtctccgggttacgtgctgggcgtctttctcaggaaactgactagccgtgagacagcacttatggtgatagggatggctatgaccacaactttgtcaatccctcacgacctgatggagttaattgacggaatcagtctcggcctgattcttctgaagatcgtaacccagttcgataacacgcaagtgggtacactagccctctccctgacctttatacgctctactatgagcttggtcatggcatggcggaccattatggccgttctgttcgtggtgacattaatcccactctgtagaacttcctgcctgcagaaacagtcacattgggtcgaaatcaccgctcttattctgggggcgcaagccttgcccgtgtatctcatgacgctgatgaagggagcaagcaggcgaagttggcctctaaatgagggcatcatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagccattacaggaagttcccctataatcgaagtgaagcaggatgaggacggcagcttttctattcgggatgtcgaggaaaccaacatgatcactttgctcgtgaaactggctctaattacagtaagcggtctgtacccccttgcaatcccaataaccatgactctctggtatatgtggcaggtcaagacacaacgctccggggccctgtgggacgtgccgtcacctgcggctacccagaaagccgcattgagtgagggagtttacagaatcatgcagaggggcttattcggcaagacgcaggtgggggtcggaattcacatggaaggtgtgttccacactatgtggcatgttacccggggcagcgtgatctgtcacgagacagggcgactggaaccctcttgggccgatgtcagaaatgacatgatttcctatggaggcggttggcgcctcggggataaatgggacaaggaggaggatgtgcaagtactggctatcgaaccaggaaagaaccccaaacatgtgcagaccaagcctggcctttttaaaacactgactggcgagataggggccgttaccttggacttcaagccaggaacgtcaggtagtcccattatcaataggaaaggcaaggtcatcgggctatacggaaacggcgtggtgacaaaaagcggtgactatgtctccgcaattactcaggctgaacgtataggggagcctgattacgaggtagacgaagatatctttcggaagaagagactgaccattatggacctccacccgggagccggcaaaacaaagaggatcctgccatctattgtgcgcgaggcgcttaaacgaagattacggaccctgatcctcgcccccactagggttgtggcagctgaaatggaggaagccttgcgcggcctgcctatacgttatcagaccccagctgtcaagtcggagcatacagggagagagatcgtggatctcatgtgccacgcaacgttcactacccggctgcttagctcaacaagggttcccaattacaacctgattgtgatggacgaagcccactttaccgatccttccagtgtcgccgctcgcggatacatctctactcgagtggagatgggtgaagcggcagccattttcatgacagctaccccgcccggcgccacggacccatttcctcaaagcaattcccccatcgaggatatagaaagagagattccagagcggtcatggaacactgggttcgactggatcacagattatcagggaaaaaccgtatggtttgtgccttctatcaaggcaggcaatgacattgccaactgcttgaggaagagcggtaaaaaggttatccagctaagtcgcaaaaccttcgacactgaataccccaagacaaaactgaccgattgggactttgtcgtgacaactgatatatccgagatgggggctaacttcagagcgggcagggtgattgacccacggcgttgtctcaagccggtcatcttaacggatggacctgaacgcgttattctggccggccccatcccagtgacccccgcaagcgctgcccaacgaagagggaggataggacggaatcctgcacaggaggacgatcagtatgtattctctggtgacccacttaagaacgatgaagaccatgcccactggacagaggctaaaatgctgctcgataatatttacactcccgagggcatcatccctaccttgtttgggccggaacgcgagaagacacaggccattgacggagaattcagactgaggggcgagcaacggaaaacctttgtggagctcatgcgaagaggtgatctgccagtctggctttcatataaggtggcgtccgcagggatcagttacaaagaccgcgaatggtgcttcactggcgagaggaacaatcagattctagaagagaacatggaagttgagatatggacgcgggagggagaaaagaagaaactgcgtcccaagtggttggacgccagagtgtatgctgatcctatggccttaaaagactttaaggagttcgctagcggcaggaaatcgaccacactggatatcctcactgaaattgcatctctgcccacctacctttccagccgcgccaagctggctctcgacaatatcgtcatgttgcatacaaccgagcgggggggacgagcctaccagcacgcactgaacgaactaccagagtcactggagactctcatgcttgtagcgctgttaggtgccatgacagctggcatctttttgttctttatgcaggggaagggaattggcaaactgagtatgggtctcataacgatcgccgtggcatctgggctgctttgggttgctgaaattcaacctcagtggatcgccgcatccattatcctggagttctttctcatggtgttgctgatacccgaaccagagaagcagagaacccctcaggataatcaattaatctatgtcattctaactatcctgacaattatcggcctcatagccgctaacgaaatgggacttattgagaaaaccaagaccgacttcggcttttaccaggtgaaaacagagactacgatcctggatgtcgacttgaggccggcgagcgcctggaccctgtatgcagtggctacaactattctcacccccatgctgcgccacacaatcgaaaatacctcagccaaccttagtctcgccgcaatagctaatcaggccgcggttctgatggggttgggaaagggctggccactgcatcggatggatttaggtgtgcctctactggctatggggtgttacagccaggtaaaccccactacgctcacagcctcccttgtgatgctgttggtccactatgcaatcattggaccaggcctgcaagccaaagctaccagagaggcacagaagcgtactgccgcgggtatcatgaagaatcctaccgttgacggcattacagtgatcgatctcgaacccatatcttacgacccgaaattcgagaagcagctggggcaagtcatgcttttagtgctgtgcgctggacagctcttgctgatgaggactacctgggccttctgtgaggtactaacactggcaacgggcccaattctcaccctttgggaagggaaccctggacggttttggaacactacaatcgccgtgagcaccgctaatatcttccgcggctcctatctggccggtgcagggttggctttttcactgattaaaaacgcccagactccccgaagaggaacaggcaccacgggtgagaccctcggcgaaaagtggaaaaggcagctgaattctttagatcggaaggagttcgaagagtacaagcgcagtgggatccttgaggttgacagaacagaagcgaaatcggccctgaaggacggaagcaaaataaagcatgcagtgtccaggggctcttcaaaaattcgatggatcgtcgagcgggggatggtgaagccaaagggaaaagtcgtggatctcggctgcggtcgtgggggatggagctactatatggctactctaaagaacgttaccgaagtaaaaggctacacaaagggcgggcccggacacgaggaacctattccgatggccacttatggttggaatctggtgaaattgcattccggcgtcgacgtgttttacaagcccaccgagcaagttgatacactgctctgtgacatcggggagagttctagcaacccaaccatagaagagggaagaactcttcgcgtgctgaagatggtcgaaccttggttgtcatccaaacccgagttctgcatcaaggtgctgaatccttatatgccaacggtaattgaagagctcgagaaattacagaggaagcacggcggtaacctggtgcggtgtccccttagtagaaatagcacacacgaaatgtactgggtttctggggcatccggaaacatcgtctcaagcgtgaataccacttcgaaaatgctgctaaaccgctttaccacaaggcatcgaaagcctacgtatgagaaagatgtggacctcggcgctggcacccggtctgtcagtactgaaacagagaagccagatatgaccattatcgggagaaggctgcagcgcttgcaggaggaacacaaggagacttggcattacgaccaagaaaatccctaccgtacatgggcctatcacggatcctacgaggccccgagcaccggttcagcgtcctctatggttaacggcgtggtaaaactgctcacaaagccttgggatgtgattccaatggtcactcagcttgctatgaccgacacgacccccttcgggcagcagcgggtgtttaaagaaaaggttgatacaagaactcctcaaccaaaacccggaaccaggatggtgatgacaactaccgcaaattggctgtgggccttactgggcaagaagaaaaacccgcgcttgtgcacgaaggaggagttcatcagcaaagtccgaagtaatgctgccataggtgcagtgtttcaggaagagcaggggtggacatccgccagcgaagctgtaaacgactctcggttctgggagctcgttgacaaggaaagagcgctgcaccaagagggaaaatgtgagtcatgcgtgtataacatgatgggcaagagggaaaagaaactaggcgagtttgggcgcgccaagggaagtagagcaatttggtacatgtggcttggtgctcggttcctggaattcgaggccctcggctttctgaatgaagatcattggttcgggagggagaactcctggagcggagtcgagggcgaaggtttgcaccgtctggggtatatcctcgaggaaatcgacaaaaaggatggagaccttatgtacgcagatgacaccgccggctgggatactcgaattacagaggacgatctgcagaatgaggaattaataaccgagcagatggctcctcatcacaaaatcctggccaaggcgatttttaagttgacttatcagaacaaagtggtgaaggtcctccgccccaccccaagaggcgcagttatggacatcatttctcggaaagatcaaagggggtcgggacaggtgggtacatacggcctgaatacgttcaccaacatggaagtacagctaatccgccagatggaggccgaaggggtgataactcaagacgatatgcagaatcctaagggacttaaagagagagtcgagaagtggctgcgggaatgcggcgtggacaggctcaaacgaatggctatctcaggtgacgattgtgttgtgaagcccctggacgagcgttttgggacaagcttgttattcctgaacgatatgggaaaggtcagaaaagacattccacagtgggaaccctccaagggctggaaaaattggcaggaggtgcctttttgcagtcatcacttccacaagatctttatgaaagatggccgctctctcgtagttccatgtcggaaccaagacgaacttattgggagggccagaatcagccagggagcaggttggtccctgcgcgagaccgcttgcctaggcaaggcctacgctcagatgtggtcactgatgtatttccatcggagggatctccgattggccagtatggcaatatgttctgcggtgccgactgagtggtttcccacaagcagaaccacgtggtccattcacgcccatcaccagtggatgacaaccgaagacatgctgaaggtctggaatcgggtgtggatcgaggataaccctaatatgactgacaaaaccccagttcactcatgggaagatatcccctaccttgggaagagggaggacctgtggtgcggaagcctcattggcttatcttcccgcgctacatgggccaaaaacatacatactgcaatcacccaagtgcgtaatctgattggtaaggaagagtatgtcgactacatgcctgtgatgaaaagatatagtgctccaagcgagtcggaaggggtattgtga

SEQ ID NO: 15743 - RNA, 9867 nt, synthetic construct
  misc_feature 1..9867: note = derived and/or modified CDS sequence (opt3) from DENV-4__FJ882586__SS-prME
  source 1..9867: mol_type = other RNA
agcaccataacactgctctgccttattcccactgtgatggccttccacctgtccacgcgggacggcgaacctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactgactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcaggattctgatcggttttcttgtattgtggattgggaccaattcaagaaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaaacttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctagggggccttacttggatggacctgttgcgggccctcattatgctgggcgataccatgtccggcagaatcgggggacagacacatctagctataatggccgttttcaagatgtctccgggttacgtgctgggcgtctttctcaggaaactgaccagccgtgagactgcacttatggtgatcgggatggctatgacaaccacattgtcaattcctcacgacctgatggagttaatcgacggaattagtctcggcctgatccttctgaagatagtaactcagttcgataacacccaagtgggtacgctagccctctccctgacatttattcgctctaccatgagcttggtcatggcatggcggactatcatggccgttctgttcgtggtgaccttaatcccactctgtagaacatcctgcctgcagaaacagtcacattgggtcgaaattactgctcttatcctgggggcgcaagccttgcccgtgtatctcatgaccctgatgaagggagcaagcaggcgaagttggcctctaaatgagggcattatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatataacgggaagttcccctatcattgaagtgaagcaggacgaggatggcagcttttctatccgggacgtcgaggaaacaaacatgattaccttgctcgtgaaactggccctaatcactgtaagcggtctgtacccccttgctataccaatcacaatgaccctctggtatatgtggcaggtcaagactcaacgctccggggcactgtgggatgtgccgagccctgccgcgacacagaaagctgccttgagtgagggagtttacagaattatgcagaggggcttattcggcaagacccaggtgggggtcggaatccacatggaaggtgtgttccacacgatgtggcatgttactcggggcagcgtgatttgtcacgagaccgggcgactggaaccctcttgggcagacgtcagaaatgatatgatctcctatggaggcggttggcgcctcggggacaaatgggataaggaggaggacgtgcaagtactggccatagaaccaggaaagaaccccaaacatgtgcagacaaagcctggcctttttaaaaccctgacaggcgagattggggctgttactttggacttcaagccaggaacctcaggtagtcccatcatcaataggaaaggcaaggtcattgggctatacggaaacggcgtggtgacgaaaagcggtgattatgtctccgccataacacaggcagaacgtatcggggagcctgactacgaggtagatgaagacatttttcggaagaagagactgactatcatggatctccacccgggagctggcaaaaccaagaggattctgccatctatcgtgcgcgaggcccttaaacgaagattacggacactgatactcgcgcccaccagggttgtggccgcagaaatggaggaggctttgcgcggcctgcctatccgttatcagactccagccgtcaagtcggagcataccgggagagagattgtggacctcatgtgccacgctacattcacgactcggctgcttagctcaaccagggttcccaattacaacctgatcgtgatggatgaagcacactttacagacccttccagtgtcgccgcccgcggatacatttctacccgagtggagatgggtgaagctgcggcaatcttcatgactgccacaccgcccggcgctaccgatccatttcctcaaagcaattcccccatagaggacattgaaagagagatcccagagcggtcatggaacacggggttcgattggatcactgactatcagggaaaaacagtatggtttgtgccttctattaaggccggcaatgacatcgcaaactgcttgaggaaatcaggtaaaaaggttatacagctaagtcgcaaaaccttcgataccgaataccccaagactaaactgacagactgggattttgtcgtgaccacagacatttccgagatgggggccaacttcagagctggcagggtgatcgatccacggcgttgtctcaagccggtcattttaactgacggacctgaacgcgttatcctggcgggccccataccagtgacgcccgccagcgcagctcaacgaagagggaggattggacggaatcctgcccaggaggatgaccagtatgtattctctggtgatccacttaagaacgacgaagatcatgcacactggaccgaggccaaaatgctgctcgacaatatctacacacccgagggcatcattcctactttgtttgggccggaacgcgagaagacccaggctatcgatggagagttcagactgaggggcgagcaacggaaaacatttgtggagctcatgcgaagaggtgacctgccagtctggctttcatataaggtggcctccgcggggattagttacaaagaccgcgaatggtgcttcaccggcgagaggaacaatcagatactagaagagaacatggaagttgagatctggactcgggagggagaaaagaagaaactgcgtcccaagtggttggatgcaagagtgtatgccgaccctatggctttaaaagattttaaggagttcgccagcggcaggaaatcgattacgctggacatcctcaccgaaatcgcttctctgcccacatacctttccagccgcgcaaagctggccctcgataatattgtcatgttgcatactaccgagagagggggccgagcttaccagcacgccctgaacgaactaccagagtcactggagacactcatgcttgtagcactgttaggtgcgatgaccgccggcatatttttgttctttatgcaggggaagggaatcggcaaactgagtatgggtctcattactatcgctgtggcctctgggctgctttgggttgcagaaattcaacctcagtggatcgctgcctccataatcctggagttctttctcatggtgttgctgattcccgaaccagagaagcagagaacacctcaggacaatcaattaatctatgtcattctaacgatcctgaccataattggcctcatcgcagccaacgaaatgggacttattgagaaaactaagacagatttcggcttttaccaggtgaaaaccgagaccacaatcctggacgtcgatttgaggccggctagcgcgtggactctgtatgccgtggcaacgaccatactcacacccatgctgcgccacactatcgaaaatacctcagctaaccttagtctcgccgccattgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccatcattggaccaggcctgcaagcaaaagccacgagagaggctcagaagcgtacagcagccggtatcatgaagaatcctaccgttgatggcataactgtgattgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaatcctcacactttgggaagggaaccctggacggttttggaacacgaccattgcagtgagcactgccaatatcttccgcggctcctatctggctggtgccgggttggcattttcactgatcaagaacgctcagacaccccgaagaggaaccggcactacaggtgagaccctcggcgaaaagtggaaaaggcagctaaattctttagaccggaaggagttcgaagagtacaagcgcagtgggattcttgaggttgacagaacggaagccaaatcggcgctgaaggatggaagcaaaatcaagcatgccgtgtccaggggatcttcaaaaattcgatggatcgtcgagcgggggatggtgaagccaaagggaaaagtcgtggacctcggctgcggtcgtgggggatggagctactatatggcaaccctaaagaacgttacagaagtaaaaggctacactaagggcgggcccggacacgaggaacctataccgatggctacctatggttggaatctggtgaaattgcattccggcgtcgatgtgttttacaagcccacagagcaagttgacactctgctctgtgatatcggggagagttctagcaacccaaccattgaagagggaagaacacttcgcgtgctgaagatggtcgaaccttggttgtcatccaaacccgagttctgcatcaaggtgctgaatccttatatgccaaccgtaattgaagaactcgagaaattacagaggaagcacggcggtaacctggtgcggtgtccccttagtagaaatagcactcacgaaatgtactgggtttctggggcctccggaaacatcgtctcaagcgtgaatacgacatcgaaaatgctgctaaaccgctttaccactaggcatcgaaagcctacctatgagaaagacgtggatctcggcgcaggcacacggtctgtcagtacggaaaccgagaagccagacatgactattatcgggagaaggctgcagcgcttgcaggaggaacacaaggagacatggcattacgatcaagaaaatccctaccgtacctgggcttatcacggatcctacgaggccccgagcactggttcagcctcctctatggttaacggcgtggtaaaactgctcacaaagccttgggacgtgataccaatggtcacccagcttgcgatgacagatactacccccttcgggcagcagcgggtgtttaaagaaaaggttgacacgagaacccctcaaccaaaacccggaacaaggatggtgatgactaccacagctaattggctgtgggcattactgggcaagaagaaaaacccgcgcttgtgcactcgagaggagttcattagcaaggtccggagtaatgccgctatcggtgccgtgtttcaggaagaacaggggtggacctccgcaagcgaagccgtaaacgactctagattctgggagctcgttgataaagaaagggctctgcaccaagagggaaagtgtgagtcatgcgtgtataacatgatgggcaaacgcgaaaagaagctaggcgagtttgggagagcgaaaggaagtcgggccatctggtacatgtggcttggtgcaaggttcctggagttcgaggctctcggctttctgaatgaagaccattggttcgggcgtgagaactcctggagcggagtcgagggcgaaggtttgcaccgactggggtatattctcgaggaaatagataagaaagacggagatcttatgtacgccgacgatacggcaggctgggacacacgcatcaccgaggatgacctgcagaatgaggaattaattactgagcagatggcccctcatcacaagatcctggctaaagccatttttaagttgacatatcagaacaaggtggtgaaagtcctcagacccaccccacggggcgcggttatggatatcatatctaggaaggaccaacgcgggtcgggacaggtgggtacttacggcctgaataccttcacaaacatggaagtacagctaatcagacagatggaggcagaaggggtgattacgcaagatgacatgcagaatcctaaaggacttaaggagcgggtcgagaaatggctgagggaatgcggcgtggaccgactcaagcgtatggccatctcaggtgatgactgtgttgtgaaacccctggatgagagatttgggaccagcttgttattcctgaacgacatgggaaaggtccgcaaggatattccacagtgggaaccctccaaaggctggaagaattggcaggaggtgcctttttgcagtcatcacttccacaaaatctttatgaaggacggccggtctctcgtagttccatgtaggaaccaagatgaacttatagggagagctcgcattagccagggagccggttggtccctgcgggagactgcatgcctaggcaaggcttacgcccagatgtggtcactgatgtatttccataggcgagacctcagattggctagtatggccatctgttctgcagtgccgacagagtggtttcccaccagccggactacatggtccatccacgcgcatcaccagtggatgaccacggaagatatgctgaaggtctggaatagggtgtggattgaggacaaccctaatatgatagataagacaccagttcactcatgggaagacatcccctaccttgggaaacgcgaggacctgtggtgcggaagcctcattggcttatcttcccgtgccacctgggctaagaacatccatactgccattgcacaagtgagaaatctgatcggtaaagaagagtatgtcgattacatgcctgtgatgaagcgatatagtgctccaagcgagtcggaaggggtattgtga

SEQ ID NO: 15744 - RNA, 9867 nt, synthetic construct
  misc_feature 1..9867: note = derived and/or modified CDS sequence (opt3) from DENV-4__JN819406__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgcccgtgagctgaagtgcgggtctggaattttcgtcgtggataatgttcatacatggaccgaacaataccagtttcagcccgagtcaccagcacggcttgcgagtgctatcctgaacgcccacaaagacggcgtgtgtgggatccgaagcactacaagattggagaatgtaatgtggaagcagattaccaacgaactcaattatgtcctgtgggagggaggccacgacttaactgtggtggcaggtgatgtcaaaggggttctgaccaagggaaaaagggccctaacacctcccgcttccgacctcaagtactcttggaagacgtggggcaaagccaagatattcaccccagaagcacgcaactcgacttttctgatcgatggtcccgacacaagcgagtgccctaatgaacggagagcttggaactccttcgaggtggaggattacggcttcgggatgtttaccacaaatatttggatgaaattcagggaaggatcaagtgaggtatgtgaccatcgccttatgtctgccgcgatcaaggatcaaaaagccgtgcacgctgacatgggctattggattgaaagctccaagaaccagacttggcagatcgagcgagcatcattgatagaagtcaaaacctgcctgtggccaaagacgcatacactctggagcaatggggtgctggagtctcagatgttaatcccgaagtcctacgccggaccctttagtcaacacaactatcggcagggctacgctacccagactgttggtccttggcacctggggaaacttgagattgatttcggagaatgcccaggcaccacagtgactatccaggagaactgtgaccatcgtggtcccagcttgagaaccacaacggcctctggcaagctcgtcacccaatggtgctgtaggtcctgcactatgcctccactgcgctttctaggggaagatggatgttggtatggcatggagattcggcccctgtcagagaaagaagagaatatggtgaagagtcaggttacagcagggcagggaaccagcgaaactttctcgatgggcctcctgtgccttacattgtttgtggaggaatgtctgagaaggcgagtcacccgcaaacacatgatcttagcggtagtgataacgctctgcgccattatcctgggtgggcttacttggatggacctgttgcgggctctcattatgctgggagataccatgtccggcagaatcggcgggcagacacatctagccataatggcagttttcaagatgtctccgggatacgtgctgggtgtctttctcaggaagctgaccagccgtgagactgctcttatggtgatcggcatggccatgacaaccacattgtcaattcctcacgacctgatggagttaatcgacgggattagtctcggactgatccttctgaaaatagtaactcaattcgataacacccaggtgggcacgctagcactctccctgacatttattcgctctaccatgagcttggtcatggcctggcggactatcatggctgttctgttcgtggtgaccttaatcccactctgtagaacatcctgcctgcagaagcaatcacattgggtcgaaattactgcgcttatcctgggtgcccaggcattgcccgtgtatctcatgaccctgatgaaaggggctagcaggcgaagttggcctctaaatgagggaattatggccgttggcctggtatctcttctcggctccgccctgttgaagaacgacgtgcccctggctgggccaatggtcgcaggaggtttactcctggccgcgtacgtgatgagcggctcgtcagctgatctttctctggaaaaagccgcaaatgttcagtgggacgagatggccgatataacggggagttcccctatcattgaagtgaagcaggacgaggatggaagcttttctatccgggacgtcgaggaaacaaacatgattaccttgctcgtgaagctggctctaatcactgtaagcggcctgtacccccttgcaataccaatcacaatgaccctctggtatatgtggcaagtcaaaactcagcgctccggtgccctgtgggatgtgccgtcacctgcggctacacagaaggccgcattgagtgagggggtttacagaattatgcagaggggattattcggcaaaacccaagtgggcgtcgggatccacatggaaggagtgttccacacgatgtggcatgttactcggggtagcgtgatttgtcacgagaccggccgactggaaccctcttgggccgacgtcagaaatgatatgatctcctatgggggaggctggcgcctcggtgacaagtgggataaagaggaggacgtgcaggtactggctatagaaccagggaagaaccccaagcatgtgcagacaaaacctggactttttaagaccctgacaggcgagattggcgccgttactttggacttcaaaccagggacctcaggaagtcccatcatcaataggaagggtaaagtcattggcctatacgggaacggagtggtgacgaagagcggcgattatgtctccgcaataacacaggctgaacgtatcggtgagcctgactacgaggtagatgaagacatttttcggaaaaagagactgactatcatggatctccacccgggggccggaaagaccaaaaggattctgccatctatcgtgcgcgaggcgcttaagcgaagattacggacactgatactcgcccccaccagggttgtggcagctgaaatggaggaagccttgcgcggcctgcctatccgttatcaaactccagctgtcaaatcggagcataccggcagagagattgtggacctcatgtgccacgcaacattcacgactcggctgcttagctcaaccagggttcccaattacaacctgatcgtgatggatgaagcccactttacagacccttccagtgtcgccgctcgcgggtacatttctacccgagtggagatgggagaagcggcagccatcttcatgactgctacaccgcccggtgccaccgatccatttcctcagagcaattcccccatagaggacattgaaagagagatcccagagcggtcatggaacacgggcttcgattggatcactgactatcaggggaagacagtatggtttgtgccttctattaaagcaggaaatgacatcgccaactgcttgaggaagagcggcaagaaagttatacaactaagtcgcaagaccttcgataccgaataccccaaaactaagctgacagactgggattttgtcgtgaccacagacatttccgagatgggtgctaacttcagagcggggagggtgatcgatccacggcgttgtctcaaaccggtcattttaactgacggccctgaacgcgttatcctggccggacccataccagtgacgcccgcaagcgctgcccagcgaagaggcaggattgggcggaatcctgcacaggaggatgaccagtatgtattctctggagatccacttaagaacgacgaagatcatgcccactggaccgaggctaagatgctgctcgacaatatctacacacccgagggtatcattcctactttgtttggcccggaacgcgagaaaacccaagccatcgatggggaattcagactgaggggagagcagcggaagacatttgtggagctcatgcgaagaggcgacctgccagtctggctttcatataaagtggcgtccgcaggtattagttacaaggaccgcgaatggtgcttcaccggggagaggaacaatcagatactagaagagaacatggaagttgagatctggactcgggagggcgaaaaaaagaagctgcgtcccaaatggttggatgccagagtgtatgctgaccctatggccttaaaggattttaaagagttcgctagcggaaggaagtcgattacgctggacatcctcaccgaaatcgcatctctgcccacatacctttccagccgcgccaaactggctctcgataatattgtcatgttgcatactaccgagcggggcgggcgagcctaccagcacgcactgaacgaactaccagagtcactggagacactcatgcttgtagcgctgttaggagccatgaccgctggtatatttttgttctttatgcaaggcaaggggatcggaaagctgagtatgggcctcattactatcgccgtggcatctggtctgctttgggttgctgaaattcagcctcagtggatcgccgcatccataatcctggagttctttctcatggtgttgctgattcccgaaccagagaaacagagaacacctcaagacaatcagttaatctatgtcattctaacgatcctgaccataattgggctcatcgccgctaacgaaatgggccttattgagaagactaaaacagatttcggattttaccaggtgaagaccgagaccacaatcctggacgtcgatttgaggccggcgagcgcctggactctgtatgcagtggctacgaccatactcacacccatgctgcgccacactatcgaaaatacctcagccaaccttagtctcgccgcaattgctaatcaggccgcggttctgatgggcttggggaaaggatggccactgcatcggatggacttaggcgtgcctctactggctatgggttgttacagccaagtaaaccccacaaccctcactgcctcccttgtgatgctgttggtccactatgcaatcattgggccaggactgcaggccaaggctacgagagaggcacagaaacgtacagccgcgggcatcatgaagaatcctaccgttgatggtataactgtgattgacctcgaacccatctcttacgatccgaagttcgagaaacaactgggccaggtcatgcttttagtgctgtgcgctgggcagctcttgctgatgaggaccacatgggccttctgtgaggtactaactctggcaaccggaccaatcctcacactttgggaaggcaaccctgggcggttttggaacacgaccattgccgtgagcactgctaatatcttccgcggatcctatctggccggcgcaggtttggctttttcactgataaagaacgcccagacaccccgaagagggaccggaactacaggcgagaccctcggtgaaaaatggaagaggcaactgaattctttagaccggaaagagttcgaagagtacaagcgcagtggcattcttgaggttgacagaacggaagcgaagtcggccctgaaagatgggagcaagatcaaacatgcagtgtccaggggatcttcaaagattcgatggatcgtcgagcggggcatggtgaaaccaaaggggaaggtcgtggacctcggatgcggccgtggtgggtggagctactatatggctaccctaaaaaacgttacagaagtaaagggatacactaaaggcggccccgggcacgaggaacctataccgatggccacctatggatggaatctggtgaagttgcattccggtgtcgatgtgttttacaaacccacagagcaggttgacactctgctctgtgatatcggcgagagttctagcaacccaaccattgaagaggggagaacacttcgcgtgctgaagatggtcgaaccttggttgtcatccaagcccgagttctgcatcaaagtgctgaatccttatatgccaaccgtaattgaagagctcgagaagttacagaggaaacacggaggcaacctggtgcggtgtccccttagtagaaatagcactcacgaaatgtactgggtttctggtgcatccgggaacatcgtctcaagcgtgaatacgacatcgaagatgctgctaaaccgctttaccactaggcatcgaaaacctacctatgagaaggacgtggatctcggagctggcacacggtctgtcagtacggaaaccgagaaaccagacatgactattatcggcagaaggctgcagcgcttgcaagaggaacacaaggagacatggcattacgatcaggaaaatccctaccgtacctgggcctatcacgggtcctacgaggccccgagcactggatcagcgtcctctatggttaacggtgtggtaaagctgctcacaaaaccttgggacgtgataccaatggtcacccagcttgctatgacagatactacccccttcggccagcaacgggtgtttaaggaaaaagttgacacgagaacccctcagccaaagcccgggacaaggatggtgatgactaccacagcaaattggctgtgggccttactgggaaaaaagaagaacccgcgcttgtgcactcgagaggagttcattagcaaagtccggagtaatgctgccatcggcgcagtgtttcaggaagagcaaggttggacctccgccagcgaagctgtaaacgactctagattctgggagctcgttgataaggaaagggcgctgcaccaggaggggaaatgtgagtcatgcgtgtataacatgatgggaaagcgcgaaaaaaagctaggcgagtttggcagagccaaggggagtcgggcaatctggtacatgtggcttggagctaggttcctggaattcgaggccctcggttttctgaatgaagaccattggttcggccgtgagaactcctggagcggggtcgagggagaaggcttgcaccgactgggttatattctcgaggaaatagataaaaaggacggggatcttatgtacgcagacgatacggccggatgggacacacgcatcaccgaggatgacctgcagaatgaggaattaattactgagcagatggctcctcatcacaaaatcctggccaaggcgatttttaaattgacatatcaaaacaaggtggtgaaggtcctcagacccaccccacggggcgcagttatggatatcatatctaggaaagaccagcgcggctcggggcaggtgggaacttacggtctgaataccttcacaaacatggaagtacagctaatcagacaaatggaggccgaaggcgtgattacgcaggatgacatgcagaatcctaaggggcttaaagagcgggtcgagaagtggctgagggaatgcggagtggaccgactcaaacgtatggctatctcaggcgatgactgtgttgtgaagcccctggatgagagatttggtaccagcttgttattcctgaacgacatggggaaagtccgcaaggatattccacagtgggaaccctccaagggatggaaaaattggcaagaggtgcctttttgcagtcatcacttccacaagatctttatgaaagacggccggtctctcgtagttccatgtaggaaccaggatgaacttataggcagagcccgcattagccagggggcaggatggtccctgcgggagactgcttgcctaggtaaggcctacgctcagatgtggtcactgatgtatttccataggcgagacctcagattggccagtatggcaatctgttctgcggtgccgacagagtggtttcccaccagccggactacatggtccatccacgcccatcaccaatggatgaccacggaagatatgctgaaagtctggaatagggtgtggattgaggacaaccctaatatgatagataagacaccagttcactcatgggaagacatcccctaccttggcaagcgcgaggacctgtggtgcgggagcctcattggattatcttcccgtgctacctgggccaaaaacatccatactgcaattacccaggtgagaaatctgatcggcaaggaagagtatgtcgattacatgcctgtgatgaaacgatatagtgctccaagcgagtcggaaggtgtattgtga

SEQ ID NO: 15745 - RNA, 9867 nt, synthetic construct
  misc_feature 1..9867: note = derived and/or modified CDS sequence (opt3) from DENV-4__GQ199876__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtgatcgggagagtaatttccgccacacccttggctgagaacaccaacagcgtgacaaatatcgagctcgaaccgcctttcggagactcgtatatagttattggtgtcggcaactctgcgctgactttacattggtttaggaaagggtcctcaatcggaaagatgttcgagagtacctaccggggcgcaaaacgcatggccatcctgggtgaaacggcttgggattttgggagcgtgggcggactattcacctccctcggcaaggccgtgcaccaggtctttgggtctgtttatacaactatgttcggaggcgtgagctggatgattagaatcctgattggttttcttgtgttgtggatagggaccaattcaaggaacacaagtatggcaatgacttgcatcgccgtaggaggcattaccctgttcctcggttttacggtccaggctgacatgggctgtgtggtttcctggagcgggcgtgagctgaagtgcggatctggcatcttcgtggtcgataatgtgcatacatggaccgaacaatacaaatttcagcccgagtcaccagcccggcttgcaagtgcgatcctgaacgctcacaaggacggggtttgtggaattcgaagcactacaagattggagaatgtgatgtggaaacagataaccaacgaactcaattatgtactgtgggagggcggtcacgacttaactgtcgtggccggggatgtgaagggagtcctgaccaaaggcaagagggcactaacacctcccgcctccgacctcaagtactcttggaaaacgtggggtaaggctaaaatcttcaccccagaagcccgcaactcgacttttctgattgatggccccgacacaagcgagtgccctaatgaacggagagcatggaactccttcgaggttgaggattacgggttcggaatgtttaccacaaatatctggatgaagttcagggaaggctcaagtgaggtgtgtgaccatcgccttatgtctgctgccattaaagatcagaaggcggtacacgccgacatggggtattggatcgaaagctccaaaaaccaaacttggcagatagagcgagcttcattgatcgaagtgaagacctgcctgtggccaaagacgcatacactctggagcaatggagtcctggagtctcagatgttaattccgaaatcctacgcaggcccctttagtcagcacaactatcggcaaggttacgccacccagactgtggggccttggcacctgggaaagcttgagatcgatttcggcgaatgcccaggtaccacagttactattcaggagaactgtgaccatcgtggccccagcttgagaaccacaacggcttctgggaaactcgtgacccagtggtgctgtaggtcctgcactatgcctccactgcgctttctaggagaagatggctgttggtatgggatggagatccggcccctgtcagagaaggaagagaatatggtcaaaagtcaagtgacagccggacagggcaccagcgaaactttctcgatgggtctcctgtgccttacattgtttgttgaggaatgtctgagaaggcgagtgacccgcaagcacatgatattagcagtcgtaattacgctctgcgcgatcattctggggggacttacttggatggacctgttgcgggccctcatcatgctgggcgataccatgtccggcagaatagggggacagacacatctagctatcatggccgtgttcaagatgtctccgggttacgttctgggcgtgtttctcaggaaactgaccagccgtgagactgcacttatggtcattgggatggctatgacaaccacattgtcaatccctcacgacctgatggagttaattgacggaatcagtctcggcctgatacttctgaagattgtgactcagttcgataacacccaagtaggtacgctagccctctccctgacatttatccgctctaccatgagcttggtgatggcatggcggactatcatggccgtcctgttcgttgtgaccttaattccactctgtagaacatcctgcctgcagaaacagtcacattgggtggaaatcactgctcttattctgggggcgcaagccttgcccgtctatctcatgaccctgatgaagggagcaagcaggcgaagttggcctctaaatgagggcataatggctgtgggcctggtttctcttctcgggtccgccctgttgaaaaacgacgtacccctggccggaccaatggtggctggtggcttactcctggcagcctacgtcatgagcgggtcgtcagcggatctttctctggaaaaggctgccaatgtgcagtgggacgagatggcagatatcacgggaagttcccctattatcgaagttaagcaggacgaggatggcagcttttctattcgggacgtggaggaaacaaacatgatcaccttgctcgtcaaactggccctaataactgtgagcggtctgtacccccttgctatcccaattacaatgaccctctggtatatgtggcaggtaaagactcaacgctccggggcactgtgggatgtcccgtcacctgccgcgacacagaaagctgccttgagtgagggagtgtacagaatcatgcagaggggcttattcggcaagacccaggttggggtgggaattcacatggaaggtgtcttccacacgatgtggcatgtgactcggggcagcgttatctgtcacgagaccgggcgactggaaccctcttgggcagacgtgagaaatgatatgatatcctatggaggcggttggcgcctcggggacaaatgggataaggaggaggacgtccaagtgctggccattgaaccaggaaagaaccccaaacatgtacagacaaagcctggcctttttaaaaccctgacaggcgagatcggggctgtgactttggacttcaagccaggaacctcaggtagtcccatcattaataggaaaggcaaggttatagggctatacggaaacggcgtcgtgacgaaaagcggtgattatgtgtccgccatcacacaggcagaacgtattggggagcctgactacgaggtcgatgaagacatctttcggaagaagagactgactattatggatctccacccgggagctggcaaaaccaagaggatcctgccatctatagtacgcgaggcccttaaacgaagattacggacactgatcctcgcgcccaccagggtggttgccgcagaaatggaggaagctttgcgcggcctgcctgtgcgttatcagactccagccgtcaagtcggagcataccgggagagagattgtggacctcatgtgccacgctacattcacgactcggctgcttagctcaaccagggttcccaattacaacctgatcgtgatggatgaagcacactttacagacccttccagtgtcgccgcccgcggatacatttctacccgagtggagatgggtgaagctgcggcaatcttcatgactgccacaccgcccggcgctaccgatccatttcctcaaagcaattcccccatagaggacattgaaagagagatcccagagcggtcatggaacacggggttcgattggatcactgactatcagggaaaaacagtatggtttgtgccttctattaaggccggcaatgacatcgcaaactgcttgaggaagagcggtaaaaaggttatacagctaagtcgcaaaaccttcgataccgaataccccaagactaaactgacagactgggattttgtcgtgaccacagacatttccgagatgggggccaacttcagagctggcagggtgatcgatccacggcgttgtctcaagccggtcattttaactgacggacctgaacgcgttatcctggcgggccccataccagtgacgcccgccagcgcagctcaacgaagagggaggattggacggaatcctgcccaggaggatgaccagtatgtattctctggtgatccacttaagaacgacgaagatcatgcacactggaccgaggccaaaatgctgctcgacaatatctacacacccgagggcatcattcctactttgtttgggccggaacgcgagaagacccaggctatcgatggagaattcagactgaggggcgagcaacggaaaacatttgtggagctcatgcgaagaggtgacctgccagtctggctttcatataaggtggcctccgcggggattagttacaaagaccgcgaatggtgcttcaccggcgagaggaacaatcagatactagaagagaacatggaagttgagatctggactcgggagggagaaaagaagaaactgcgtcccaagtggttggatgcaagagtgtatgccgaccctatggctttaaaagattttaaggagttcgccagcggcaggaaatcgattacgctggacatcctcaccgaaatcgcttctctgcccacatacctttccagccgcgcaaagctggccctcgataatattgtcatgttgcatactaccgagcgggggggacgagcttaccagcacgccctgaacgaactaccagagtcactggagacactcatgcttgtagcactgttaggtgcgatgaccgccggcatatttttgttctttatgcaggggaagggaatcggcaaactgagtatgggtctcattactatcgctgtggcctctgggctgctttgggttgcagaaattcaacctcagtggatcgctgcctccataatcctggagttctttctcatggtgttgctgattcccgaaccagagaagcagagaacacctcaggacaatcaattaatctatgtcattctaacgatcctgaccataattggcctcatcgcagccaacgaaatgggacttattgagaaaactaagacagatttcggcttttaccaggtgaaaaccgagaccacaatcctggacgtcgatttgaggccggctagcgcgtggactctgtatgccgtggcaacgaccatactcacacccatgctgcgccacactatcgaaaatacctcagctaaccttagtctcgccgccattgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccatcattggaccaggcctgcaagcaaaagccacgagagaggctcagaagcgtacagcagccggtatcatgaagaatcctaccgttgatggcataactgtgattgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaatcctcacactttgggaagggaaccctggacggttttggaacacgaccattgcagtgagcactgccaatatcttccgcggctcctatctggctggtgccgggttggcattttcactgataaaaaacgctcagacaccccgaagaggaaccggcactacaggtgagaccctcggcgaaaagtggaaaaggcagctgaattctttagaccggaaggagttcgaagagtacaagcgcagtgggattcttgaggttgacagaacggaagccaaatcggcgctgaaggatggaagcaaaatcaagcatgccgtgtccaggggctcttcaaaaattcgatggatcgtcgagcgggggatggtgaagccaaagggaaaagtcgtggacctcggctgcggtcgtgggggatggagctactatatggcaaccctaaagaacgttacagaagtaaaaggctacactaagggcgggcccggacacgaggaacctataccgatggctacctatggttggaatctggtgaaattgcattccggcgtcgatgtgttttacaagcccacagagcaagttgacactctgctctgtgatatcggggagagttctagcaacccaaccattgaagagggaagaacacttcgcgtgctgaagatggtcgaaccttggttgtcatccaaacccgagttctgcatcaaggtgctgaatccttatatgccaaccgtaattgaagagctcgagaaattacagaggaagcacggcggtaacctggtgcggtgtccccttagtagaaatagcactcacgaaatgtactgggtttctggggcctccggaaacatcgtctcaagcgtgaatacgacatcgaaaatgctgctaaaccgctttaccactaggcatcgaaagcctacctatgagaaagacgtggatctcggcgcaggcacacggtctgtcagtacggaaaccgagaagccagacatgactattatcgggagaaggctgcagcgcttgcaggaggaacacaaggagacatggcattacgatcaagaaaatccctaccgtacctgggcttatcacggatcctacgaggccccgagcactggttcagcctcctctatggttaacggcgtggtaaaactgctcacaaagccttgggacgtgataccaatggtcacccagcttgcgatgacagatactacccccttcgggcagcagcgggtgtttaaagaaaaggttgacacgagaacccctcaaccaaaacccggaacaaggatggtgatgactaccacagctaattggctgtgggcattactgggcaagaagaaaaacccgcgcttgtgcactcgagaggagttcattagcaaggtccggagtaatgccgctatcggtgccgtgtttcaggaagagcaggggtggacctccgcaagcgaagccgtaaacgactctagattctgggagctcgttgataaagaaagggctctgcaccaagagggaaagtgtgagtcatgcgtgtataacatgatgggcaaacgcgaaaagaagctaggcgagtttgggagagcgaaaggaagtcgggccatctggtacatgtggcttggtgcaaggttcctggaattcgaggctctcggctttctgaatgaagaccattggttcgggcgtgagaactcctggagcggagtcgagggcgaaggtttgcaccgactggggtatattctcgaggaaatagataagaaagacggagatcttatgtacgccgacgatacggcaggctgggacacacgcatcaccgaggatgacctgcagaatgaggaattaattactgagcagatggcccctcatcacaagatcctggctaaagccatttttaagttgacatatcagaacaaggtggtgaaagtcctcagacccaccccacggggcgcggttatggatatcatatctaggaaggaccaacgcgggtcgggacaggtgggtacttacggcctgaataccttcacaaacatggaagtacagctaatcagacagatggaggcagaaggggtgattacgcaagatgacatgcagaatcctaaaggacttaaggagcgggtcgagaaatggctgagggaatgcggcgtggaccgactcaagcgtatggccatctcaggtgatgactgtgttgtgaaacccctggatgagagatttgggaccagcttgttattcctgaacgacatgggaaaggtccgcaaggatattccacagtgggaaccctccaaaggctggaagaattggcaggaggtgcctttttgcagtcatcacttccacaaaatctttatgaaggacggccggtctctcgtagttccatgtaggaaccaagatgaacttatagggagagctcgcattagccagggagccggttggtccctgcgggagactgcatgcctaggcaaagcttacgcccagatgtggtcactgatgtatttccataggcgagacctcagattggctagtatggccatctgttctgcagtgccgacagagtggtttcccaccagccggactacatggtccatccacgcgcatcaccagtggatgaccacggaagatatgctgaaggtctggaatagggtgtggattgaggacaaccctaatatgacagataagaccccagttcactcatgggaagacataccctaccttgggaaacgcgaggacctgtggtgcggaagcctcatcggcttatcttcccgtgccacttgggctaagaacattcataccgccatcacacaagtgagaaatctgattggtaaagaagagtatgtcgattacatgcctgtgatgaagcgatatagtgcaccaagcgagtcggaaggggtattgtga

SEQ ID NO: 15746 - RNA, 9867 nt, synthetic construct
  misc_feature 1..9867: note = derived and/or modified CDS sequence (opt3) from DENV-4__KP723482__SS-prME
  source 1..9867: mol_type = other RNA
agcaccatgaccctgctctgccttatccccactgtgatggcattccacctgtccacgcgggacggcgagcctttgatgattgtcgctaagcatgaaagagggcggccattactgtttaagaccacagaggggataaacaagtgtactctaatcgcaatggatctcggtgaaatgtgcgaggacaccgttacatacaaatgtccgctgcttgtgaataccgaacccgaggatattgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtaacactcacgccgtcgggaatgataccagcaaccacggcgtgacagcaaccataactcctcgttccccatcagtagaggttaagttaccggactacggagaactgacgctcgattgcgagccccgcagtggcattgacttcaatgagatgatccttatgaagatgaaaaagaaaacatggctggtgcataagcagtggtttttggacctacctctgccatggaccgctggggccgatactagcgaagtccactggaactacaaagagagaatggtgaccttcaaggtcccccatgcgaaaaggcaggacgtgacagttctcggatctcaggaaggtgccatgcactccgcactggctggcgccaccgaggtggattcaggggacggaaatcacatgtttgctggccatcttaagtgtaaggtacggatggaaaaactgcgaattaagggtatgagctatactatgtgcagtgggaaattctctatcgataaggagatggccgagacacaacacggcacgaccgtcgtgaaagttaagtacgaaggagcaggcgccccttgtaaggtgccaatcgagattcgcgacgtcaacaaagaaaaggtggtagggagaataatctccagcactcccttcgctgagaacacaaattcggtgaccaacattgagttggaaccgccttttggagattcttatatcgttataggtgtcggcgactccgcgctcacactgcattggttcaggaaagggtcaagtattggaaagatgtttgagagcacttaccggggcgcaaaacgcatggccatcttaggtgaaaccgcttgggatttcgggtccgtgggcggactgtttacgtctctaggcaaggccgtgcaccaggtcttcgggagcgtttataccacaatgtttggaggcgtgtcatggatgatcaggattctcatcggtttcctggtgctttggattgggactaatagtaggaacacctccatggcaatgacatgcatagccgtaggaggcatcactttgtttctgggtttcaccgtccaggctgacatgggctgtgtggttagctggaatgggaaggagctcaaatgcggatctggcatttttgtggtcgataacgtgcatacgtggacagaacaatacaagttccagcccgagtcaccagcccgtctggcaagtgcgatccttaatgctcacaaagacggggtttgtggaatccggagcaccactcgactggagaacgtgatgtggaagcagattacaaatgaattgaactatgtactctgggagggcggtcacgacctgaccgtcgtggccggggatgtgaaaggagtcttaactaagggcaagagagcactgacccctcccgttaatgacctaaaatactcctggaagacatggggtaaagccaagatatttacgccagaagctaggaactctaccttcctcatcgatggccccgacacttcggagtgccctaatgaacgccgggcctggaacttctttgaggtggaggattacgggttcggaatgtttacaaccaatatttggatgaaattcagagaaggcagctccgaggtatgtgaccataggctgatgtcagcagctatcaaggatcagaaagccgtgcacgcggacatggggtattggattgaaagttctaagaaccaaacatggcagatcgagaaggccagccttatagaagtcaaaacttgcttgtggccaaagacccatacgctgtggtccaacggagtgctcgagtcacagatgctgatcccgcgcagctacgctggccccttttctcagcacaattatcgacaaggttacgcaacacagaccgccgggccttggcacttaggaaaactggagattgatttcggcgaatgcccaggtactaccgttacaatccaggaggactgtgatcatcggggcccctcccttcgtactaccacagctagtgggaagttggtgacgcagtggtgctgtagaagctgcaccatgcctccactcaggtttctgggagaagacggctgttggtatgggatggagattcgccccctatctgagaaagaagagaacatggtcaagtcccaagtgactgccggacagggcacatcagaaaccttcagtatgggtctgctctgcctgactctttttgttgaggaatgtttgcggagaagggtgacacgaaagcacatgatcctggcagtcgtaataaccttctgcgcgattatcttagggggactcacgtggatggatctgcttcgcgtgctgattatgttgggcgacactatgagcggccggatcgggggacagatacatctcgccatcatggctgtttttaaaatgtcgccgggttacgtgctgggcgtcttcctaagaaagctgacctccagggagacagccctcatggtgattgggatggcaatgaccactgtattttctatccctcacgacctgatggagcttattgatggaatcagcttgggcctgatattactcaaaattgtgacacatttcgacaatacccaggtcggtacactggctctttcactgactttcatccgtagtaccacgcccctggttatggcctggcgcacaatcatggcagtgtttttcgtggtcaccctcattcccctgtgtcggacttcctgcttgcaaaagcagtctcactgggtggaaatcaccgccctgattttaggggctcaggcgctccctgtttatctgatgacacttatgaaaggagccagcagaaggtcctggcccctgaacgagggcataatggcagtaggcttggtgtcactcctggggagcgctctactgaagaatgatgtcccacttgccggacctatggtggccggtggcctcctgttggctgcatacgttatgagtgggtcttccgccgacctgagcttagaaaaggcggctaacgtgcaatgggatgagatggccgacatcactggatcgtcacccattatcgaagtcaaacaggatgaggacggctcttttagtattcgagatgtggaggaaaccaatatgatcacgctcctggtaaaacttgcactgataacagtctccggtttgtacccactcgccatcccggtgaccatggctctgtggtatgtttggcaagtgaaaactcagcggagcggggcactatgggacgtcccttctcccagcgccacacaaaaggcgaccctgtccgagggagtgtaccgcattatgcagagaggccttttcggcaaaactcaggttggggtgggaatccacatggaaggtgtctttcatacaatgtggcacgtgaccaggggctcagtaatttgtcatgagacggggcggctcgaaccaagttgggctgatgtgcgaaacgacatgatcagctatggaggcggttggagactgggggataagtgggacaaggaggaggacgttcaggtcttggccatagaacccggcaagaatcctaagcacgtgcaaactaaaccaggcttattcaagaccctgacaggcgagattggggcagtgaccctcgattttaaacccggaacatctggttcccctatcatcaacaagaaaggcaaggtcattgggctgtacggaaatggcgtagtgactaagtcaggtgactatgttagtgccataacccaggctgaacgcatcggggagccggattacgaggtggacgaagatattttcaggaaaaagcgtcttacgatcatggacctgcatccaggagccggcaaaacaaagcggattttgcccagcatcgtcagagaggcactaaaaaggcgcctgcgaactctcatactggctcctaccagagtggttgccgcggaaatggaggaagcccttcggggcttaccaatcaggtatcagacacccgcagtgaagtccgagcacaccgggcgcgagattgtcgatctgatgtgccacgctacttttaccacacgtctcttgtcttcgacgagagtgcctaactacaatctgatcgtaatggacgaagcccatttcactgatccgtgcagcgtggctgcacggggatacatttcaaccagggttgagatgggtgaagccgccgctatctttatgacagcgacaccaccaggctccatagaccctttcccccagagtaactctccaattgaggatatcgaacgcgagatccctgagcgaagctggaatactgggttcgactggattacagactatcaaggaaagaccgtctggtttgtgccctccatcaaagcaggcaacgatatagccaactgtctcagaaagtcaggtaaacgggtgattcagctgtctaggaagacgttcgacactgaatacccaaaaacaaaacttaccgattgggactttgtcgttaccactgatatcagcgagatgggggctaatttccgcgccggcagagtgattgacccgaggcggtgcctgaagcctgtaatcttgacagatggacccgaacgtgtgatactagcaggcccaattcccgtcacccctgccagtgctgcgcagcgccgagggagaatcggaaggaacccagcccaagaggacgatcagtatgtgttttccggtgaccccctgaaaaatgatgaagaccacgcacattggacagaggctaagatgctcttagataacatctacactcctgagggcattatcccgacgctgttcgggccagaacgggagaaaacccaggccattgacggagaatttcgccttagaggcgagcagaggaagacattcgttgagctgatgcggcgaggtgacctccccgtgtggttgagctataaagtcgcatctgccgggatatcatacaaggatagagaatggtgttttactggcgagcgcaataaccaaatcctggaagagaatatggaagtagagatttggaccagggagggagaaaagaaaaagctccggcctaaatggctggacgctcgtgtgtatgccgatcccatggcgcttaaggacttcaaagagtttgcatccggcagaaagagtatcacactagatatcctgaccgaaattgccactttgccaacgtacttaagctcgaaggctaaactggccctcgacaacatagttatgctgcacaccacagagaaaggtgggagggcttaccagcacgcacttaatgaactgcctgagtctctcgagactttgatgctggtggccctactgggggctatgaccgccggcatcttcctctttttcatgcaggggaaaggaattggcaaactttccatgggtctgatcgcaattgcggtcgccagcgggttattgtgggtggctgaaatccagccccaatggatagccgcatcaatcattctggagttctttctcatggtcctgcttatcccagaacctgagaaacagcgcacaccgcaggataaccagctgatttatgtgatcctcaccatattgactattatcggcctgattgctgccaatgaaatgggattaatcgagaagacaaaaacggacttcggcttttaccaagttaagcccgagaccactatactagatgtggacctgcggccagcaagtgcctggacactctatgctgtagcgaccaccatccttacacctatgctgcgacatactattgaaaacacgtctgccaatttgtccctggcagctatcgccaaccaggccgcagtgctcatggggctgggaaagggctggccccttcacagaatggatctcggtgtcccactgttggctatggggtgctacagccaggttaatcctaccacactgactgcctcattagtgatgctactggtccattatgcgattatcggacccggcctccaggctaaagccaccagggaggcacaaaagcgcacagccgctggtataatgaaaaacccgaccgtggacggcattactgtaatcgatcttgaaccaatcagttacgaccctaagttcgagaaacagctgggacaggtgatgttgctggttctctgtgtgggacaactgcttttaatgcggacgacatgggcactgtgcgaggtcctcaccttggccactggccccgtgatgaccctgtgggaagggaacccaggaagattttggaatacaactattgcggtcagcaccgctaacatcttccgtggctcctatctagccggtgcagggctggccttttctctcataaagaatgctcagacacccaggcggggaacgggcaccactggtgagacacttggcgaaaagtggaaacgccagctgaacagcttggaccgaaaggagttcgaagagtacaaaagatccgggattctggaggtggataggaccgaagccaagtcagcactccgggacggaactaaaatcaagtacgctgtttctcgcggcagttcgaagattagatggatcgtagagagggggatgataaaacctaagggaaaagtggtcgatctgggctgtggtcgagggggatggagctattacatggccacattaaagaatgtgaccgaagttaaaggctatacgaagggcgggccgggacacgaggaacccatcccaatggcgacctacggttggaaccttgtgaagctgcattccggcgtcgacgtgttttataaacctacagagcaggtagatactctcctatgcgacattggggagtcttcaagcaatcccaccatcgaagagggacggacactgcgtgtgttgaagatggttgaaccttggctgtccagtaaaccagagttctgtattaaggtcctcaacccctacatgcctactgtgatcgaagaacttgagaaactgcaaagacgccacggcggttctttggtgaggtgcccactgagcagaaattcaacccacgaaatgtattgggtctccggggccagtggaaacattgttagctctgtgaatacaatctccaagatgctcttaaacagatttaccactcgccataggaaacccacgtacgagaaggatgtagacctgggcgcaggcacacgatcagtgagcaccgaaactgagaagccggatatgaccgtcatagggcggagacttcagaggctgcgcgaggaacacaaagagacatggcattacgaccaggaaaatccttatcgtacgtgggcttaccacggatcgtatgaggccccatctaccggtagtgcatccagcatggtgaacggcgttgtgaagctactcactaaaccctgggatgtcattcctatggtgacacagctggctatgaccgacactacaccattcgggcaacagcgggtatttaaggaaaaagttgacaccagaacaccccagccgaagcctggaactaggatgatcatgaccacgaccgccaattggttgtgggccctgctcggcaagaaaaagtcaccccgcctttgtacacgagaggagttcatctccaaagtgcggtctaacgcggctattggtgcagtcttccaggaggaacaggggtggactagcgccagtgaagctgtgaatgattccagattttgggagctggtggacaaggaaagggccttacaccaggagggaaaatgcgagagctgcgtctacaacatgatgggcaagcgcgaaaagaaactgggcgagttcgggagagcaaagggatctcgggccatatggtatatgtggttgggtgctaggtttctcgagttcgaggcgctgggctttctaaacgaagatcattggttctcacgtgagaatagttggtccggggttgagggagaaggccttcaccgactgggttacatcctcgaggacattgataaaaaggacggggatctgatctatgccgacgataccgcaggatgggacacacgcattactgaagatgacttgctgaacgaggagctcatcaccgaacagatggctccacatcacaaaacgcttgccaaggcaatatttaagctgacataccaaaataaagtggtaaaggtgttaagacctacccccaaaggcgccgtcatggatatcattagccggaaggaccagaggggctctggacaggtgggaacttacggtctgaacacattcaccaatatggaggttcagttgatccgccaaatggaagctgagggcgtgattactcaggacgatatgcagaacccaaaagggctcaaggaaagagtcgagaaatggctgaaggagtgtggagtggaccggctaaagaggatggccatctcgggcgatgactgcgtagttaaaccccttgatgaacgattttcaaccagcctactcttcctgaatgacatgggtaaggtgcgtaaagatatacctcagtgggagccatccaaggggtggaaaaactggcaagaagtcccgttttgtagtcatcacttccacaagatttttatgaaggacggaagatctttggtggttccctgccgcaatcaggatgagttaatcggccgggcgaggatcagccagggcgcagggtggtccctgagagaaacagcctgtctcggaaaggcttatgcccagatgtggtcacttatgtacttccatcgccgggacctgaggctagcaagtatggctatttgctctgccgtgcctacggagtggttcccaaccagccgaactacatggtccatacacgctcatcaccaatggatgaccactgaggatatgctgaaggtctggaacagagtgtggatcgaagacaatcccaacatgacagacaaaacccctgtacactcatgggaggatattccatatctcggtaagcgggaagacttgtggtgtggcagcctgatcgggctttcttccagggccacgtgggccaagaatattcatacagcgatcacccaggtgcgcaacctgataggaaaggaggaatacgtcgattatatgcccgccatgaagcgttacagtgctccttttgagagcgagggcgttctctga

SEQ ID NO: 15747 - RNA, 9867 nt, synthetic construct
  misc_feature 1..9867: note = derived and/or modified CDS sequence (opt3) from DENV-4__JN638570__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctgcctgggtaatgtatggcacatgcacccagtcaggggagcgccgacgtgaaaagagaagtgtggcgttgacgcctcacagcggaatgggcctcgagactagggctgaaacctggatgtcctctgagggtgcctggaaacatgcacaacgggtcgagtcgtggattctgcgcaatccagggttcgccctgctcgctggatttatggcatacatgatcggccagacaggcatacagagaactgtgttctttatcttaatgatgctggttgccccctcatatgggatgaggtgtgtgggagtcggtaaccgggatttcgtggaaggcgtaagcgggggagcttgggttgaccttgtgttggagcacggcggttgcgtcaccacaatggcccaggggaagcctaccctggattttgaactaattaagacgactgcgaaagaggtggcactcctgcgcacatactgtatcgaagccagtatttccaatatcaccactgctacacgatgcccaacccaaggagagccctatcttaaggaggaacaggaccagcagtacatatgtagaagggatatggtggaccggggctggggcaacgggtgcggactgttcggtaaaggcggggtcgttacgtgcgccaagttttcttgtttgggaaaaattaccggcaatctcgtgcaaatcgagaacctggaatatacagtagtggtcactgtgcataatggtgatacccacgcagttgggaacgacacaagcaatcacggcgtgactgctaccattacacctcgttccccatcagtcgaggtgaagttaccggattacggagaactgaccctcgactgcgagccccgcagtggcatcgacttcaacgagatgatccttatgaagatgaaaactaagacgtggctggtacataaacagtggtttttggatctacctctgccatggacaaccggggccgacactctcgaagttcactggaatcataaggagagaatggtgaccttcaaagtcccccacgcgaagaggcaggatgtgacagtcctgggaagccaggaaggtgccatgcactctgcacttgctggcgccaccgaggtggactccggggatggaaaccatatgtttgctggccacctgaaatgtaaggttcggatggaaaagttgcgaattaaaggtatgtcatacactatgtgcagcgggaagttcagtatagacaaagagatggccgagacacaacatggcacgaccgtggtaaaggtcaaatatgaaggaactggcgcaccttgtaaggtgccaatcgagattcgcgatgttaataaggaaaaagtggtcgggagaatcatatcttccacacccttcgccgagaacaccaacagcgtgacaaatattgagctcgaaccgccttttggagactcgtacatcgtaatcggtgtgggcgatggggctctgactttacactggttcaggaagggatcttccattggcaaaatgtttgagtcaacctatcggggtgcgaagcgcatggcaatcctgggggaaacggcctgggacttcggcagtgttggaggcctactcaccagcctggggaaagctgtccatcaggtgtttggatccgtgtacacaactatgttcggcggtgtctcttggatggttagaattcttatagggttgctggtgctctggatcggaaccaacagcaggaatacatcaatggccatgagttgcattgcagtgggcggtatcactctgtttcttggcttcaccgtacacgccgatatggggtgtgtcgtgtcctggagcggaaaggagctgaagtgcggctctgggatctttgttattgacaacgtgcacacgtggacagaacagtataaattccaacccgagtcaccagctcgtttggccagtgcaatactcaatgcgcataaggagggagtctgtggcatccggagcaccactcgactggaaaacgtgatgtggaaacagattacaaatgagttaaactacgttctgtgggaaggtgggcacgacctaaccgtggtagctggagatgtcaagggcgtgctctccaaaggtaagagagccctggcacctcccgtgaatgaccttaagtattcttggaaaacttggggcaaggccaaaatctttaccccagagacaaggaactcgacgttcttggtcgatgggcccgacaccagcgaatgccctaatgagcgccgggcttggaactttctggaggttgaagattacggattcggcatgttcactacaaatatttggatgaagtttagagaggggtccccagaagtgtgtgaccataggctcatgtcagccgcaatcaaagatcagaaggctgtacacgccgacatgggatactggatagagagttctaaaaaccagacctggcaaatcgaaaaggcgagcctgattgaggtgaagacatgcttatggccgaaaactcacaccctgtggtccaatggcgtccttgagtcacagatgttgatccccaaggcctatgctggtcctattagccagcataactaccgccaggggtatgcaacgcaaacagccggaccatggcacctcggcaaactggaaatcgatttcggtgagtgccccggcaccactgtgaccgttcaggaagactgtgatcatcgagggccttctctacggacaactaccgcttccggaaagctggtgacacagtggtgctgtcgtagttgcacgatgccacccctcagatttctgggcgaggacgggtgttggtacggaatggagataaggccgcttaacgaaaaagaggaaaatatggtcaagagccaggtgtctgccggccaaggtacctccgagactttctcaatggggttgctgtgcttaacactctttgttgaagagtgtctgcgccggagagtgaccaggaagcacatgatgcttgtcgtagtgactacactgtgcgcaattatcttgggaggcctcacctggatggatctgctacgagcgctgattatgctcggcgacacgatgagtgggcgcatgggaggtcagatccatctggccataatggctgttttcaaaatgagccctggctatgtgcttgggatctttttgcggaagctgacttcgagagagaccgccttaatggtcattggaatggcaatgacaaccgtgctcgctatcccacacgacctgatggaattcattgatggcatctcccttggtctgatactactcaaaatggtaactcactttgacaacacacaggtggggaccctggccttggcactgacattcattaagtctactatgcccttagtcatggcctggaggaccatcatggctgttctctttgtggtgacgctgatccctctttgtcgtacaagctgcctgcagaaacaatcacattgggtcgagattaccgcgttgatcctcggagcccaggcactgcccgtgtacctaatgactctgatgaagggcgctagtaagcgctcctggccacttaatgaaggcattatggccgttgggctcgtatctctgttgggaagcgccctgttaaaaaacgatgtgcctctcgctggtcccatggtcgcaggcgggctgcttctggccgcgtatgtgatgtccggatcaagcgctgacttgagtctcgagaaggccgcaaatgttcggtgggatgaaatggccgacataaccggctcttccccaatcattgaggtgaaacaggatgaggacggtagcttctcgatcagagatgtcgaagagacaaacatgattactctgctagtgaagctggctcttatcaccgtatcagggctctacccgctggcaatacctgtcacgatgacattgtggtacatgtggcaagtgaaaacccagaggtctggagccttatgggacgttcccagtccagcggctgcccagaaggcaactctgacagaaggcgtgtatcgaatcatgcagcggggcctctttgggaagacccaagtcggagtgggtattcacactgagggcgttttccatacaatgtggcacgtgacccgcgggtccgtcatctgtcatgaaagcggaagactggagccctcttgggccgatgtgaggaatgacatgattagctacggcggtgggtggcggcttggagataaatgggacaaggaggaagacgtacaggtgctggctatcgagcctggcaaaaacccaaagcacgttcagacgaaacccggcttgttcaagactctaaccggggaaataggagccgtcacactggattttaaacctggtacctccggctcaccgattatcaatcgaaaggggaaggtgatcggactctatggcaacggtgtggtcacaaaaagtggggactacgtaagcgcaattactcaggctgagagaataggagagccagattatgaagtggacgaggatatcttccgcaagaaaaggctgaccattatggaccttcaccccggcgccggcaagacgaaacgtatcttaccttctattgttcgggaagcgctgaagagaaggctccgcacattgatcctggccccaactcgagtggtcgcagctgagatggaagaggccctcagagggctgcccatacggtaccaaacccctgctgtgaagtccgagcatacaggaagggaaatcgttgatcttatgtgccacgcaacctttactacccgcctgttgtcaagtacacgtgtgccgaattataacctaattgtcatggacgaggcccatttcacggatcccagctccgtggccgctagaggttacatctctactcgggtagaaatgggcgaggcggcagccatttttatgaccgctacaccacctgggaccactgaccccttcccacagtcgaatagccctatcgaagatatagagagggagattcccgaacgctcatggaacacaggatttgactggatcaccgactaccagggcaaaacggtgtggttcgttccatccatcaaggccggtaatgatattgcaaactgcctgcgaaaaagtgggaagaaagtcatccagctctctagaaagacttttgacacagagtatccgaagaccaaattaaccgattgggacttcgtggtgactacagatataagcgaaatgggcgccaactttcgggctggaagggtcattgaccctcgcagatgtctgaagcccgttatccttaccgatggcccagagagggtgattctggcggggcccatccctgtaacaccagcctccgcagctcaacggcgtggacgcataggtcgaaatcccgcccaggaagacgatcagtacgtgttctcaggcgaccctctcagaaacgatgaggaccacgcacactggactgaggccaaaatgttgctggataatatttatacgccggaagggatcatcccaaccctcttcggacccgagagggaaaagacacaagctattgacggcgagtttcggctgcgcggtgagcagagaaaaactttcgtcgaacttatgaggcggggggacctacctgtgtggctgtcttacaaggttgccagcgcgggcatcagttataaggatcgagagtggtgctttaccggagaaagaaacaatcagattttggaggaaaacatggaggtggagatatggacacgcgaaggcgagaaaaagaaattaaggcccaagtggctggacgcacgggtctacgccgatccaatggctctcaaagacttcaaggaatttgcctccgggcgtaagagcatcaccctggatattcttactgagatcgcttctctgcctacgtatctctcatccagagcaaaattggccctggacaatatcgtaatgctacataccacagaaaggggaggtaaggcttaccagcacgccctgaacgagctccccgagagtcttgaaactctgatgttagtggcattgctgggcgcgatgaccgccgggattttcctctttttcatgcaaggaaaaggcataggtaagctgagcatggggcttatcgctattgccgttgcatcgggcctgctctgggtggctgagatccagccacagtggattgccgcatctatcatattggaatttttcctgatggtcttactagtgcctgagccggaaaaacagcgcacaccccaagataatcagctgatctacgtcattctcaccatccttactattatcgccctggtggctgcgaacgagatgggattgatagagaagacaaaaacggactttggcttctatcaggttaaggccgaaaccactattctggatgtggacctccggccagcatccgcttggacactgtacgccgtagccaccaccatccttacacctatgctccgacatactattgagaatacgagcgcaaacctgtcattggctgccatcgcgaatcaggctgccgtgctgatggggttaggaaagggctggcccctacacagaatggatctgggtgtcccactccttgcaatggggtgttatagtcaagttaaccctaccacactgactgcctctttggtgatgctgctcgtccattacgctataatcggacccggcctgcaggcaaaagccaccagggaagcgcagaagcgcacagctgccggtattatgaaaaatccgaccgtggacggcatcactgtaattgatcttgagccaatctcctatgaccctaagtttgagaaacagttagggcaagtgatgctgctcgttttgtgcgcaggacagctgctactgatgcggacgacatgggccttctgtgaagtgctcacccttgctactggccccatactgaccttgtgggaggggaacccaggaagattctggaacacaactattgccgtcagcaccgcaaatatctttcgtggctcatacctggctggtgccgggctcgcgttcagtctgatcaagaacgcccagacacccaggcggggaacgggcaccactggtgaaacattaggcgagaagtggaaacgccaacttaatagcctggaccgaaaggaatttgaggagtataaaagatccgggattctcgaagtggataggaccgaggcaaagtctgctctaaaagacggaagcaagatcaagtacgccgtctcccggggcacttcaaaaatacgctggattgtggaaagagggatggttaagcctaaaggaaaggtagtggatctgggctgcggtagggggggatggtcttactatatggcaacattgaaaaacgtcaccgaggtgaagggctacacgaagggcgggccgggacacgaagagcccatcccaatggctacctatggttggaatctggttaaactccacagtggcgtggacgtcttctacaagcctacagagcaggtggatactcttctgtgtgacattggggaatcgagctccaaccccaccatcgaggaaggacgaacattgcgggtactgaaaatggtggagccttggctctcttcaaagccagaattttgcataaaagttttaaatccctatatgcctactgtcatcgaggagctggaaaagcttcagcgtagatacggcggtagcctggtgcgctgtccactatccaggaacagtacccatgagatgtattgggtgtctggggtcagcggaaatattgtttcatccgtgaacacaaccagtaaaatgctcctgaatcggttcactacgagacaccgcaagcccacatacgaaagggatgccgacttgggcgccggcacccgaagcgtatctactgagaccgagaagccggatatgacaatcattgggcggagactgcagaggctccaagaagagcataaagaaacgtggcactacgaccacgagaacccttatcgcacctgggcgtaccatggatcctatgaagctccatcaactggtagcgcatcgtctatggtgaatggcgtcgtgaagcttctgacaaaaccctgggatgttgtgcctatggtcacccagttagccatgactgacacaaccccatttgggcagcagcgtgtgttcaaggagaaagtagacacacggactccccaaccgaagcctggaaccagagttgtgatgacgaccacagctaactggctgtggactttgctcggcaggaagaaaaatccccgcctgtgcacccgagaggaatttatcagtaaggtccggtccaacgccgcaattggtgccgtgttccaggaggaacaggggtggacaagcgcttcagaggcggtgaatgattccagattttgggaactagtcgacaaagagagggcccttcaccaggagggaaagtgtgaatcttgcgtttacaacatgatgggcaaacgcgagaagaagctgggcgaattcgggagagcaaaaggaagccgggctatctggtatatgtggctcggtgccaggtttctggagttcgaagcattgggcttcctgaacgaggatcattggtttgggcgtgagaatagttggtccggagtggaaggcgagggtctccaccgacttgggtacatactggaagacattgataagaaagacggagatttaatctatgccgacgatactgctggctgggacacccgcatcacggaggatgacctgttgaacgaggaactcattacagagcaaatggccccacatcacaagatactggcgaaagcaatcttcaagctaacctaccagaataaggtagtgaaagtccttagacctactcccaagggcgccgtgatggatattatcagccggaaagaccagagggggtctggacaagttggtacatacggcctgaacacctttactaatatggaagtgcagctcattcgccagatggaggctgaaggggtcatcaccagagacgatatgcacaacccaaagggactgaaagagcgggtggagaagtggttgaaagaatgcggcgtagacaggttaaagcgaatggccatatcaggtgatgactgtgttgtgaagcccctggatgagcgtttcagtacatccctcctttttctgaatgacatggggaaagtcagaaaggatatccctcagtgggaaccaagcaaaggatggaagaactggcaagaggtgccgttctgctctcatcactttcataaaattttcatgaaggacggccgctcgctagttgtgccctgtcggaatcaggatgaactgatcggcagggcaagaatttcacagggggctggatggagcctccgcgagacggcctgcttgggtaaggcttatgcccagatgtggtccctgatgtactttcaccggagggaccttcgactggcaagtatggcgatctgttctgccgtccctaccgagtggttcccaactagcagaacaacctggtccatacacgctcatcaccaatggatgactacagaagatatgctcaaagtgtggaaccgggtatggattgaggacaatcccaacatgatcgacaagacccctgtgcattcatgggaagatatcccatatttaggcaaaagggaggacctgtggtgcgggagtttgattggactgtctagccgcgccacgtgggcaaagaatatacacacagctatcacccaggtccgtaacctcattggcaaagaagagtacgttgattatatgcccgccatgagacgatactccgcacattttgagtcagaaggtgtgctttga

SEQ ID NO: 15748 - RNA, 9867 nt, synthetic construct
  misc_feature 1..9867: note = derived and/or modified CDS sequence (opt3) from DENV-4__JN638571__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctgcctgggtaatgtatggcacatgcacccagtcaggggagcgccgacgtgaaaagagaagtgtggcgttgacgcctcacagcggaatgggcctcgagactagggctgaaacctggatgtcctctgagggtgcctggaaacatgcacaacgggtcgagtcgtggattctgcgcaatccagggttcgccctgctcgctggatttatggcatacatgatcggccagacaggcatacagagaactgtgttctttatcttaatgatgctggttgccccctcatatgggatgaggtgtgtgggagtcggtaaccgggatttcgtggaaggcgtaagcgggggagcttgggttgaccttgtgttggagcacggcggttgcgtcaccacaatggcccaggggaagcctaccctggattttgaactaattaagacgactgcgaaagaggtggcactcctgcgcacatactgtatcgaagccagtatttccaatatcaccactgctacacgatgcccaacccaaggagagccctatcttaaggaggaacaggaccagcagtacatatgtagaagggatatggtggaccggggctggggcaacgggtgcggactgttcggtaaaggcggggtcgttacgtgcgccaagttttcttgtttgggaaaaattaccggcaatctcgtgcaaatcgagaacctggaatatacagtagtggtcactgtgcataatggtgatacccacgcagttgggaacgacacaagcaatcacggcgtgactgctaccattacacctcgttccccatcagtcgaggtgaagttaccggaatacggagagctgaccctcgattgcgagccccgcagtggcatcgacttcaacgaaatgatccttatgaagatgaaaactaagacgtggctggtacataaacagtggtttttggacctacctctgccatggacaaccggggccgatactctcgaggttcactggaatcataaggaaagaatggtgaccttcaaagtcccccacgcgaagaggcaggacgtgacagtcctgggaagccaggagggtgccatgcactctgcacttgctggcgccaccgaagtggattccggggacggaaaccatatgtttgctggccacctgaaatgtaaggttcggatggagaagttgcgaattaaaggtatgtcatacactatgtgcagcgggaagttcagtatagataaagagatggccgaaacacaacatggcacgaccgtggtaaaggtcaaatatgagggaactggcgcaccttgtaaggtgccaatcgaaattcgcgacgttaataaggagaaagtggtcgggagaatcatatcttccacacccttcgccgagaacaccaacagcgtgacaaatattgaactcgagccgccttttggagattcgtacatcgtaatcggtgtgggcgacggggctctgactttacactggttcaggaagggatcttccattggcaaaatgtttgaatcaacctatcggggtgcgaagcgcatggcaatcctgggggagacggcctgggatttcggcagtgttggaggcctactcaccagcctggggaaagctgtccatcaggtgtttggatccgtgtacacaactatgttcggcggtgtctcttggatggttagaattcttatagggttgctggtgctctggatcggaaccaacagcaggaatacatcaatggccatgagttgcattgcagtgggcggtatcactctgtttcttggcttcaccgtacacgccgacatggggtgtgtcgtgtcctggagcggaaaggaactgaagtgcggctctgggatctttgttattgataacgtgcacacgtggacagagcagtataaattccaacccgagtcaccagctcgtttggccagtgcaatactcaatgcgcataaggaaggagtctgtggcatccggagcaccactcgactggagaacgtgatgtggaaacagattacaaatgaattaaactacgttctgtgggagggtgggcacgacctaaccgtggtagctggagacgtcaagggcgtgctctccaaaggtaagagagccctggcacctcccgtgaatgatcttaagtattcttggaaaacttggggcaaggccaaaatctttaccccagaaacaaggaactcgacgttcttggtcgacgggcccgataccagcgagtgccctaatgagcgccgggcttggaactttctggaagttgaggactacggattcggcatgttcactacaaatatttggatgaagtttagagaagggtcctcagaggtgtgtgatcataggctcatgagtgccgcaatcaaagaccagaaggctgtacacgccgatatgggatactggatagaatctagcaaaaaccagacctggcaaatcgagaaggcgtccctgattgaggtgaagacatgcttatggccaaaaactcacaccctgtggtcaaatggcgtccttgaaagccagatgttgatcccgaaggcctatgctggtcccatttctcagcataactaccgccaggggtatgcaacgcaaacagccggaccttggcacctcggcaaactggagatcgacttcggtgaatgcccaggcaccactgtgaccgttcaggaggattgtgaccatcgagggccctccctacggacaactaccgctagtggaaagctggtgacacagtggtgctgtcgtagctgcacgatgcctccactcagatttctgggcgaggatgggtgttggtacggaatggaaataaggccccttaacgagaaagaagagaatatggtcaagtctcaggtgtccgccggccaaggtacctcagaaactttcagtatggggttgctgtgcttaacactctttgttgaggagtgtctgcgccggagagtgaccaggaagcacatgatgcttgtcgtagtgactacactgtgcgcaattatcttgggaggcctcacctggatggacctgctacgagcgctgattatgctcggcgatacgatgagcgggcgcatgggaggtcagatccatctggccataatggctgttttcaaaatgtcgccgggctatgtgcttgggatctttttgcggaagctgacttccagagaaaccgccttaatggtcattggaatggcaatgacaaccgtgctcgctatccctcacgacctgatggagttcattgacggcatctctcttggtctgatactactcaaaatggtaactcactttgataacacacaggtggggaccctggccttggcactgacattcattaagagcactatgccattagtcatggcctggaggaccatcatggctgttctctttgtggtgacgctgatccccctttgtcgtacatcatgcctgcagaaacaaagtcattgggtcgaaattaccgcgttgatcctcggagcccaggcactgcctgtgtacctaatgactctgatgaagggcgcttccaagcgctcttggccccttaatgagggcattatggccgttgggctcgtaagcctgttgggatccgccctgttaaaaaacgacgtgccactcgctggtcctatggtcgcaggcgggctgcttctggccgcgtatgtgatgtcaggaagcagtgctgatttgtctctcgaaaaggccgcaaatgttcggtgggacgagatggccgatataaccggctccagccccatcattgaggtgaaacaggacgaagatggttcgttctcaatcagagacgtcgaggaaacaaacatgattactctgctagtgaagctggctcttatcaccgtatctgggctctacccactggcaataccggtcacgatgacattgtggtacatgtggcaagtgaaaacccagaggagtggagccttatgggatgttccttcccccgcggctgcccagaaggcaactctgacagagggcgtgtatcgaatcatgcagcggggcctctttgggaagacccaagtcggagtgggtattcacactgaaggcgttttccatacaatgtggcacgtgacccgcgggagcgtcatctgtcatgagtctggaagactggagccaagctgggccgacgtgaggaatgatatgatttcctacggcggtgggtggcggcttggagacaaatgggataaggaagaggacgtacaggtgctggctatcgaacccggcaaaaaccctaagcacgttcagacgaaaccaggcttgttcaagactctaaccggggagataggagccgtcacactggactttaaacccggtacctcaggcagtcctattatcaatcgaaaggggaaggtgatcggactctatggcaacggtgtggtcacaaaaagcggggattacgtatctgcaattactcaggctgagagaataggagaaccggactatgaggtggatgaagacatcttccgcaagaaaaggctgaccattatggatcttcacccaggcgccggcaagacgaaacgtatcttaccctccattgttcgggaggcgctgaagagaaggctccgcacattgatcctggcccctactcgagtggtcgcagctgaaatggaggaggccctcagagggctgccaatacggtaccaaacccccgctgtgaagtcagaacatacaggaagggagatcgttgaccttatgtgccacgcaacctttactacccgcctgttgagtagcacacgtgtgcctaattataacctaattgtcatggatgaagcccatttcacggacccgtcctctgtggccgctagaggttacatctcgactcgggtagagatgggcgaagcggcagccatttttatgaccgctacacccccagggaccactgatcctttcccccagagcaattcaccaatcgaggacatagagagggaaattcctgagcgctcctggaacacaggatttgattggatcaccgactaccagggcaaaacggtgtggttcgttcccagtatcaaggccggtaatgacattgcaaactgcctgcgaaaatctgggaagaaagtcatccagctcagcagaaagacttttgatacagaatatccaaagaccaaattaaccgactgggatttcgtggtgactacagacatatccgagatgggcgccaactttcgggctggaagggtcattgatccgcgcagatgtctgaagcctgttatccttaccgacggccccgaaagggtgattctggcggggccaatccccgtaacacctgcctcagcagctcaacggcgtggacgcataggtcgaaatccagcccaggaggatgaccagtacgtgttctctggcgatcccctcagaaacgacgaggatcacgcacactggactgaagccaaaatgttgctggacaatatttatacgcctgaggggatcatcccgaccctcttcggaccagaaagggagaagacacaagctattgatggcgagtttcggctgcgcggtgaacagagaaaaactttcgtcgagcttatgaggcggggggacctacccgtgtggctgagctacaaggttgccagtgcgggcatctcctataaggaccgagaatggtgctttaccggagagagaaacaatcagattttggaagagaacatggaggtggaaatatggacacgcgagggcgaaaaaaagaaattaaggcctaagtggctggatgcacgggtctacgccgaccccatggctctcaaagatttcaaggagtttgccagcgggcgtaagtctatcaccctggacattcttactgaaatcgcttcactgccaacgtatctctccagtagagcaaaattggccctggataatatcgtaatgctacataccacagagaggggaggtaaggcttaccagcacgccctgaacgagctccctgaaagccttgagactctgatgttagtggcattgctgggcgcgatgaccgccgggattttcctctttttcatgcaaggaaaaggcataggtaagctgtcgatggggcttatcgctattgccgttgcatctggcctgctctgggtggctgaaatccagccccagtggattgccgcatccatcatattggagtttttcctgatggtcttactagtgccagaacctgagaaacagcgcacaccgcaagacaatcagctgatctacgtcattctcaccatccttactattatcgccctggtggctgcgaacgagatgggattgatagaaaagacaaaaacggattttggcttctatcaggttaaggccgagaccactattctggacgtggatctccggcccgcaagcgcttggacactgtacgccgtagccaccaccatccttacaccaatgctccgacatactattgaaaatacgtcagcaaacctgagtttggctgccatcgcgaatcaggctgccgtgctgatggggttaggaaagggctggcctctacacagaatggacctgggtgtccccctccttgcaatggggtgttattctcaagttaacccaaccacactgactgcctccttggtgatgctgctcgtccattacgctataatcggacctggcctgcaggcaaaagccaccagggaggcgcagaagcgcacagctgccggtattatgaaaaatcccaccgtggatggcatcactgtaattgaccttgagccgatcagctatgatccaaagtttgaaaaacagttagggcaagtgatgctgctcgttttgtgcgcaggacagctgctactgatgcggacgacatgggccttctgtgaggtgctcacccttgctactggccctatactgaccttgtgggaagggaaccccggaagattctggaacacaactattgccgtctcaaccgcaaatatctttcgtggcagttacctggctggtgccgggctcgcgttcagcctgatcaagaacgcccagacaccaaggcggggaacgggcaccactggtgagacattaggcgaaaagtggaaacgccaacttaattccctggaccgaaaggagtttgaggaatataaaagatctgggattctcgaggtggacaggaccgaagcaaagagcgctctaaaagatggatccaagatcaagtacgccgtctcacggggcacttctaaaatacgctggattgtggagagagggatggttaagcccaaaggaaaggtagtggacctgggctgcggtagggggggatggagttactatatggcaacattgaaaaacgtcaccgaagtgaagggctacacgaagggcgggcctggacacgaggagccgatccccatggctacctatggttggaatctggttaaactccactcgggcgtggatgtcttctacaagccaacagaacaggtggacactcttctgtgtgatattggggagagctcctctaaccctaccatcgaagagggacgaacattgcgggtactgaaaatggtggaaccctggctctcaagcaagcctgagttttgcataaaagttttaaatccatatatgcccactgtcatcgaggaactggagaagcttcagcgtagatacggcggttccctggtgcgctgtcctctaagtaggaactctacccatgaaatgtattgggtgagcggggtctcaggaaatattgtttccagtgtgaacacaaccagcaaaatgctcctgaatcggttcactacgagacaccgcaagccaacatacgagagggacgccgatttgggcgccggcacccgatctgtatccactgagaccgaaaagcccgacatgacaatcattgggcggagactgcagaggctccaagaggaacataaagagacgtggcactacgatcacgaaaacccgtatcgcacctgggcgtaccatggatcatatgaggctcctagcactggttcggcatctagtatggtgaatggcgtcgtgaagcttctgacaaaaccatgggacgttgtgcccatggtcacccagttagccatgactgatacaaccccttttgggcagcagcgtgtgttcaaggagaaagtagacacacggactccacaacccaagccgggaaccagagttgtgatgacgaccacagctaactggctgtggactttgctcggcaggaagaaaaatcctcgcctgtgcacccgagaagagtttatctccaaggtccggctaaacgccgcaattggtgccgtgttccaggaagagcaggggtggacaagcgcttcagaagcggtgaatgactccagattttgggagcttgtcgataaagagagggccctgcaccaggaaggaaagtgtgagtcttgcgtttacaacatgatgggcaaacgcgaaaagaagctcggcgagttcgggagagcaaaaggaagccgggctatctggtatatgtggctgggtgccaggtttttggaattcgaggcactgggcttcctcaacgaggaccattggtttgggcgtgaaaatagttggtccggagtggagggcgaaggtcttcaccgactggggtacatattagaggatattgacaagaaagatggagacctgatctatgccgatgacactgctggctgggatacccgcatcacggaggacgatttgctcaacgaagagctgattacagaacaaatggccccccatcacaagatactagcgaaagcaatcttcaagcttacctaccagaataaggtagtgaaagtcctgagaccaactcctaagggcgccgtgatggacattatcagccggaaagatcagagggggtctggacaagttggtacatacggcctcaacacctttactaatatggaggtgcagctgattcgccagatggaagctgagggggtcatcaccagagacgacatgcacaaccccaagggattgaaagagcgggtggaaaagtggttaaaagagtgcggcgtagataggctgaagcgaatggccatatcaggtgacgattgtgttgtgaagccactcgacgaacgtttcagtacatcccttctgtttctaaatgatatggggaaagtcagaaaggacatcccccagtgggagcctagcaaaggatggaagaactggcaagaagtgccattctgctctcatcactttcataaaattttcatgaaggatggccgctcgctggttgtgccgtgtcggaatcaggacgagctcatcggcagggcaagaatttcacagggggctggatggagcttgcgcgagacggcctgcctgggtaaggcttatgcccagatgtggtcccttatgtactttcaccggagggatctgcgactcgcaagtatggcgatctgttctgccgtccccaccgaatggttccctactagcagaacaacctggtccatacacgctcatcaccaatggatgactacagaggacatgttaaaagtgtggaaccgggtatggattgaagataatccaaacatgatcgacaagacccccgtgcattcatgggaggacatcccttatctgggcaaaagggaagatttgtggtgcgggagtctgattggactctctagccgcgccacgtgggcaaagaatatacacacagctatcacccaggtccgtaaccttattggcaaagaggagtacgttgactatatgccagccatgagacgatactccgcacattttgaatcagagggtgtgctgtga

SEQ ID NO: 15749 - RNA, 9867 nt, synthetic construct
  misc_feature 1..9867: note = derived and/or modified CDS sequence (opt3) from DENV-4__JN638572__SS-prME
  source 1..9867: mol_type = other RNA
agcacaatcacactgctctgccttattcccactgtgatggccttccacctgtccacgagagacggcgagcctttgatgatagtcgctaagcatgaaagggggcggccattactgtttaaaaccacagagggaatcaacaagtgtactttaattgcaatggatctcggtgaaatgtgcgaggacaccgttacatacaaatgtccgctgcttgtgaataccgaacccgaggatatcgactgctggtgtaacctgacttctgcctgggtaatgtatggcacatgcacccagtcaggggagcgccgacgtgaaaagagaagtgtggcgttgacgcctcacagcggaatgggcctcgagactagggctgaaacctggatgtcctctgagggtgcctggaaacatgcacaacgggtcgagtcgtggattctgcgcaatccagggttcgccctgctcgctggatttatggcatacatgatcggccagacaggcatacagagaactgtgttctttatcttaatgatgctggttgccccctcatatgggatgaggtgtgtgggagtcggtaaccgggatttcgtggaaggcgtaagcgggggagcttgggttgaccttgtgttggagcacggcggttgcgtcaccacaatggcccaggggaagcctaccctggattttgaactaattaagacgactgcgaaagaggtggcactcctgcgcacatactgtatcgaagccagtatttccaatatcaccactgctacacgatgcccaacccaaggagagccctatcttaaggaggaacaggaccagcagtacatatgtagaagggatatggtggaccggggctggggcaacgggtgcggactgttcggtaaaggcggggtcgttacgtgcgccaagttttcttgtttgggaaaaattaccggcaatctcgtgcaaatcgagaacctggaatatacagtagtggtcactgtgcataatggtgatacccacgcagttgggaacgacacaagcaatcacggcgtgactgctaccattacacctcgttccccatcagtcgaggtgaagttaccggaatacggagagctgaccctcgattgcgagccccgcagtggcatcgacttcaacgaaatgatccttatgaagatgaaaactaagacgtggctggtacataaacagtggtttttggacctacctctgccatggacaaccggggccgatactctcgaggttcactggaatcataaggaaagaatggtgaccttcaaagtcccccacgcgaagaggcaggacgtgacagtcctgggaagccaggagggtgccatgcactctgcacttgctggcgccaccgaagtggattccggggacggaaaccatatgtttgctggccacctgaaatgtaaggttcggatggagaagttgcgaattaaaggtatgtcatacactatgtgcagcgggaagttcagtatagataaagagatggccgaaacacaacatggcacgaccgtggtaaaggtcaaatatgagggaactggcgcaccttgtaaggtgccaatcgaaattcgcgacgttaataaggagaaagtggtcgggagaatcatatcttccacacccttcgccgagaacaccaacagcgtgacaaatattgaactcgagccgccttttggagattcgtacatcgtaatcggtgtgggcgacggggctctgactttacactggttcaggaagggatcttccattggcaaaatgtttgaatcaacctatcggggtgcgaagcgcatggcaatcctgggggagacggcctgggatttcggcagtgttggaggcctactcaccagcctggggaaagctgtccatcaggtgtttggatccgtgtacacaactatgttcggcggtgtctcttggatggttcggattcttatagggttgctggtgctctggatcggaaccaacagcaggaatacatcaatggccatgagttgcattgcagtgggcggtatcactctgtttcttggcttcaccgtacacgccgacatggggtgtgtcgtgtcctggagcggaaaggaactgaagtgcggctctggggtttttgtgatcgataacgtccacacgtggacagagcagtataaattccaacccgagtcaccagctcgtttggccagtgcaattctcaatgcgcataaggaaggagtgtgtggcatacggagcaccactcgactggagaacgttatgtggaaacagatcacaaatgaattaaactacgtgctgtgggagggtgggcacgacctaaccgtagtcgctggagacgtgaagggcgtgctctccaaaggtaagagagccctggcacctcccgtcaatgatcttaagtattcttggaaaacttggggcaaggccaaaatttttaccccagaaacaaggaactcgacgttcttggttgacgggcccgataccagcgagtgccctaatgagcgccgggcttggaactttctggaagtggaggactacggattcggcatgttcactacaaatatctggatgaagtttagagaagggtcctcagaggtatgtgatcataggctcatgagtgccgcaattaaagaccagaaggctgtgcacgccgatatgggatactggatcgaatctagcaaaaaccagacctggcaaatagagaaggcgtccctgatcgaggtcaagacatgcttatggccaaaaactcacaccctgtggtcaaatggcgtgcttgaaagccagatgttgattccgaaggcctatgctggtcccatctctcagcataactaccgccaggggtatgcaacgcaaacagccggaccttggcacctcggcaaactggagattgacttcggtgaatgcccaggcaccactgttaccgtgcaggaggattgtgaccatcgagggccctccctacggacaactaccgctagtggaaagctggtcacacagtggtgctgtcgtagctgcacgatgcctccactcagatttctgggcgaggatgggtgttggtacggaatggaaatcaggccccttaacgagaaagaagagaatatggtgaagtctcaggtttccgccggccaaggtacctcagaaactttcagtatggggttgctgtgcttaacactctttgtggaggagtgtctgcgccggagagtcaccaggaagcacatgatacttgtagtggttactacactgtgcgcaattatcttgggaggcctcacctggatggacctgctacgagcgctgattatgctcggcgatacgatgagcgggcgcatgggaggtcagatccatctggccataatggctgtgttcaaaatgtcgccgggctatgtccttgggatctttttgcggaagctgacttccagagaaaccgccttaatggtgattggaatggcaatgacaaccgtactcgctatccctcacgacctgatggagttcattgacggcatctctcttggtctgatactactcaaaatggtgactcactttgataacacacaggtcgggaccctggccttggcactgacattcattaagagcactatgccattagttatggcctggaggaccatcatggctgtgctctttgtggtcacgctgatccccctttgtcgtacatcatgcctgcagaaacaaagtcattgggtggaaattaccgcgttgatcctcggagcccaggcactgcctgtttacctaatgactctgatgaagggcgcttccaagcgctcttggccccttaatgagggcattatggccgtagggctcgtgagcctgttgggatccgccctgctaaagaacgacgtcccactcgctggtcctatggtggcaggcgggctgcttctggccgcgtatgttatgtcaggaagcagtgctgatttgtctctcgaaaaggccgcaaatgtgcggtgggacgagatggccgatataaccggctccagccccatcattgaggtcaaacaggacgaagatggttcgttctcaatcagagacgtggaggaaacaaacatgattactctgctagtaaagctggctcttatcaccgtctctgggctctacccactggcaataccggtgacgatgacattgtggtacatgtggcaagttaaaacccagaggagtggagccttatgggatgtgccttcccccgcggctgcccagaaggcaactctgacagagggcgtctatcgaatcatgcagcggggcctctttgggaagacccaagtgggagttggtattcacactgaaggcgtgttccatacaatgtggcacgtcacccgcgggagcgtgatctgtcatgagtctggaagactggagccaagctgggccgacgtaaggaatgatatgatttcctacggcggtgggtggcggcttggagacaaatgggataaggaagaggacgtgcaggttctggctatcgaacccggcaaaaaccctaagcacgtccagacgaaaccaggcttgttcaagactctaaccggggagataggagccgtgacactggactttaaacccggtacctcaggcagtcctattatcaatcgaaaggggaaggtgatcggactctatggcaacggtgtcgtaacaaaaagcggggattacgtgtctgcaattactcaggctgagagaataggagaaccggactatgaggttgatgaagacatcttccgcaagaaaaggctgaccattatggatcttcacccaggcgccggcaagacgaaacgtatcttaccctccattgtgcgggaggcgctgaagagaaggctccgcacattgatcctggcccctactcgagtcgtggcagctgaaatggaggaggccctcagagggctgccaatacggtaccaaacccccgctgttaagtcagaacatacaggaagggagatcgtggaccttatgtgccacgcaacctttactacccgcctgttgagtagcacacgtgtccctaattataacctaattgtgatggatgaagcccatttcacggacccgtcctctgtagccgctagaggttacatctcgactcgggtggagatgggcgaagcggcagccatttttatgaccgctacacccccagggaccactgatcctttcccccagagcaattcaccaatcgaggacatagagagggaaattcctgagcgctcctggaacacaggatttgattggatcaccgactaccagggcaaaacggtttggttcgtccccagtatcaaggccggtaatgacattgcaaactgcctgcgaaaatctgggaagaaagtgatccagctcagcagaaagacttttgatacagaatatccaaagaccaaattaaccgactgggatttcgtggtcactacagacatatccgagatgggcgccaactttcgggctggaagggttattgatccgcgcagatgtctgaagcctgtgatccttaccgacggccccgaaagggtaattctggcggggccaatccccgtgacccctgcatcagcagctcaacggcgtggacgcataggtcgaaatccagcccaggaggatgaccagtacgtcttctctggcgatcccctcagaaacgacgaggatcacgcacactggactgaagccaaaatgttgctggacaatatttatacgcctgaggggatcatcccgaccctcttcggaccagaaagggagaagacacaagctattgatggcgagtttcggctgcgcggtgaacagagaaaaactttcgtggagcttatgaggagaggggacctacccgtttggctgagctacaaggtggccagtgcgggcatctcctataaggaccgagaatggtgctttaccggagagagaaacaatcagattttggaagagaacatggaggtcgaaatatggacacgcgagggcgagaagaagaaattaaggcctaagtggctggatgcacgggtatacgccgaccccatggctctcaaagatttcaaggagtttgccagcgggcgtaagtctatcaccctggacattcttactgaaatcgcttcactgccaacgtatctctccagtagagcaaaattggccctggataatatcgtgatgctacataccacagagaggggaggtaaggcttaccagcacgccctgaacgagctccctgaaagccttgagactctgatgttagttgcattgctgggcgcgatgaccgccgggattttcctctttttcatgcaaggaaaaggcataggtaagctgtcgatggggcttatcgctattgccgtggcatctggcctgctctgggtcgctgaaatccagccccagtggattgccgcatccatcatattggagtttttcctgatggtgctattagtcccagaacctgagaaacagcgcacaccgcaagacaatcagctgatctacgtgattctcaccatccttactattatcgccctggttgctgcgaacgagatgggattgatagaaaagacaaaaacggattttggcttctatcaggtgaaggccgagaccactattctggacgtagatctccggcccgcaagcgcttggacactgtacgccgtggccaccaccatccttacaccaatgctccgacatactattgaaaatacgtcagcaaacctgagtttggctgccatcgcgaatcaggctgccgtcctgatggggttaggaaagggctggcctctacacagaatggacctgggtgttcccctccttgcaatggggtgttattctcaagtgaacccaaccacactgactgcctccttggtcatgctgctcgtgcattacgctataatcggacctggcctgcaggcaaaagccaccagggaggcgcagaagcgcacagctgccggtattatgaaaaatcccaccgtagatggcatcactgtgattgaccttgagccgatcagctatgatccaaagtttgaaaaacagttagggcaagttatgctgctcgtgttgtgcgtcggacagctgctactgatgcggacgacatgggcactctgtgaggtgcttaccctggccactggccctataatgaccttgtgggaagggaaccccggaagattctggaacacaactattgctgtctcaaccgccaatatcttccgtggcagttacctggccggtgctgggctcgcctttagcctgatcaagaacgcgcagacaccaaggcggggaacgggcaccactggtgagacattaggcgaaaagtggaaacgccaacttaattccctggaccgaaaggagttcgaggaatataaaagatctgggattctcgaggtggacaggaccgaagccaagagcgcactacgggatggatccaaaactaagcacgctgtttcacgcggctctagtaagatcagatggatagtagagagggggatgattaaacccaagggaaaagtggtcgacctgggctgcggtcgagggggatggtcgtactacatggccacattgcagaacgtgaccgaagttaagggctatacgaaaggcgggcctggacacgaggagccgatccccatggcaacctacggttggaatctggtgaagctccatagcggcgtcgatgtgttttataagccaacagaacaggtagacactcttctgtgtgatattggggagtcctcttcaaaccctaccatcgaagagggacggacattgcgtgtgctgaaaatggttgaaccctggctcagctccaagcctgagttctgcataaaagtcttaaatccatacatgcccactgtgatcgaggaactggagaaacttcagagacgctatggcggtagtctggtgaggtgtcctctatctcggaacagcacccacgaaatgtactgggtctcaggggtttccggaaatattgtgagtagcgtaaacacaacctctaaaatgctcctgaatagatttactacgcgccataggaagccaacatatgagcgagacgctgatttgggcgccggcacccggtccgtgtcaactgagaccgaaaaacccgacatgacaatcattgggagaaggctgcaacgcctccaggaggaacacaaggagacgtggcactacgatcatgaaaacccgtaccgtacctgggcctatcacggaagctacgaggcgccttcgactggttctgctagttccatggtcaatggcgtggttaaacttctgacaaaaccatgggacgtggtccccatggtgacccagttagcaatgactgatacaacccctttcgggcagcaacgggtatttaaggagaaagttgacacaagaactccacagcccaagccgggaaccagggtggtcatgacgaccacagccaactggctgtggactttgctcggccgcaaaaagaatcctcgactgtgcacccgggaagagttcatcagcaaggtgagatcaaacgctgccattggtgcagtgtttcaggaggaacaggggtggacatccgcctctgaagctgtcaatgacagcaggttctgggagctagttgataaagagcgcgcgcttcatcaagaaggaaagtgtgagagttgcgtgtataacatgatgggcaaaagagaaaagaaactgggcgagtttgggcgggccaagggatccagggcaatctggtacatgtggctcggtgctcgtttcctggaatttgaggccttgggcttcctgaacgaggaccactggttcgggcgagaaaatagctggtctggagtagagggcgaaggtctccatcgccttgggtatatactggaggatattgacaagaaagatggagacttaatctacgcagatgacactgccggctgggataccagaatcacggaggacgatctgttgaacgaagaactcattacagaacagatggctccccaccacaaggtgctggccaaagcgatatttaagctaacctatcagaataaagtcgtgaaggttcttcggccaactcctaagggcgcagtgatggacatcatttcaaggaaagatcaacgcgggagtggacaggtcggtacatacggcctgaacaccttcactaatatggaggtgcagctcatcagacagatggaagccgagggggtaattacccgggacgacatgcataaccccaagggactgaaagagagggttgaaaagtggttgaaagagtgcggcgtggatcgattaaagcgtatggctatctccggtgacgattgtgtcgtgaaaccactggacgaaagatttagcacatctctccttttcctgaatgatatggggaaggttcgcaaggacataccccaatgggagccttcgaaaggatggaagaactggcaggaagtgccattttgctcacaccatttccacaaaatctttatgaaggatggccggagcctagtcgtgccgtgtaggaatcaggacgagctgattggcagagcccgcatctcccagggggcaggatggagtctccgggagacggcttgcttgggtaaagcctacgctcaaatgtggtctctgatgtatttccacaggcgagatcttagactggccagcatggcaatttgttccgcggtacccaccgaatggtttcctacttcacggacaacctggagtatccatgcccaccatcagtggatgactacagaggacatgctcaaggtgtggaacagggtctggatagaagataatccaaacatgaccgacaagacgcccgttcactcttgggaggacattccttacttaggcaaacgcgaagatctgtggtgcgggagcttgatcggactgtcctcacgtgctacatgggccaagaatatccataccgcaattactcaggtgagaaacctcataggcaaagaggagtatatggactacatgccagtcatgaagcgatatagcgctccctctgaatccgagggtgtgctttga

SEQ ID NO: 15750 - RNA, 9867 nt, synthetic construct
  misc_feature 1..9867: note = derived and/or modified CDS sequence (opt3) from DENV-4__JX024757__SS-prME
  source 1..9867: mol_type = other RNA
agcaccatgacactgctctgccttatccccactgtgatggccttccacctgtccacgagagacggcgagcctttgatgattgtcgctaagcatgaaagggggcggccattactgtttaaaaccacagagggaataaacaagtgtactctaatcgcaatggatctcggtgaaatgtgcgaggacaccgttacatacaaatgtccgctgcttgtgaataccgaacccgaggatattgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtgatactcacgccgtcgggaacgacaccagcaatcacggcgtgacagcaaccataactcctcgttccccatcagtagaggttaagttaccggattacggagaactgacgctcgactgcgagccccgcagtggcattgacttcaacgagatgatccttatgaagatgaaaaagaaaacatggctggtgcataagcagtggtttttggatctacctctgccatggagcgctggggccgacacctctgaagtccactggaattacaaagagagaatggtgactttcaaggtcccccatgcgaaaaggcaggatgtgaccgttctcggatcccaggaaggtgccatgcactcagcactggctggcgccacagaggtggacagcggggatggaaaccacatgtttgctggccatcttaagtgtaaggtacggatggaaaaactgcgaattaagggtatgagttataccatgtgctctgggaaattctccatcgacaaggagatggccgagactcaacacggcacaacggtcgtgaaagttaagtacgaaggagcaggcgccccttgtaaggtgccaatcgagattcgcgatgtcaataaagaaaaggtggtagggagaataatcagctcgacccccttcgctgagaacactaactctgtgacaaatattgagttggaaccgccttttggagactcctatatcgttataggtgtcggcgattcagcgctcaccctgcattggttcaggaaagggagtagcattggaaagatgtttgagtccacataccggggcgcaaaacgcatggccatcttaggtgaaactgcttgggacttcgggtctgtgggcggactgtttaccagcctaggcaaggccgtgcaccaggtcttcgggtcagtttatacgaccatgtttggaggcgtgagttggatgatcagaattctcatcggtttcctggtgctttggattgggacaaactccaggaatactagcatggcaatgacctgcatagccgtaggaggcatcacattgtttctgggtttcactgtccaggctgatatgggctgtgtggtttcttggaacgggaaggagctcaaatgcggatcaggcatttttgtggtcgacaatgtgcatacctggacggaacaatacaagttccagcccgagagtccagcccgtctggcaagcgcgatccttaacgctcacaaagacggggtttgtggaatccggtccacaacccgactggagaatgtgatgtggaagcagattactaacgaattgaattatgtactctgggagggcggtcacgatctgacagtcgtggccggggacgtgaaaggagtcttaaccaagggcaagagagcactgactcctcccgttaacgatctaaaatactcttggaagacctggggtaaagccaagatatttacaccagaagctaggaattcgacgttcctcatcgacggccccgataccagcgagtgccctaacgggcgccgggcctggaatttcctggaagtggaggactacggatttggcatgttcactacaaacatttggatgaaatttagagaggggtcctcagaagtatgtgatcataggcttatgagtgcagctatcaaggaccagaaagccgtgcacgcggatatgggatattggattgagtctagcaagaatcaaacctggcagatcgaaaaggcctccttgatagaggtcaaaacatgcctgtggccaaagactcataccctctggtcaaacggcgtgctggaaagccagatgttaatcccgcgctcttacgctggtcccttctcccagcacaactatcgacaagggtacgcaacgcagacagccggaccttggcacctgggcaaacttgagattgactttggtgagtgcccaggcaccactgttaccatccaggaagattgtgaccatcgggggcccagtttgcgtacaactaccgctagcggaaagctcgtgacacagtggtgctgtagatcttgcacgatgcctccactgaggttcctaggcgaggatgggtgttggtatggaatggaaattcgccccctgtccgagaaagaggaaaatatggtcaagtcacaagtgaccgccggccagggtactagtgagacatttagcatggggctcctgtgccttaccttgttcgttgaagagtgtctgcggagaagggtgactcgaaagtacatgatgttagtcgtagtgatcacattttgcgcaataattctcggaggcctgacctggatggaccttctgcgcgcgttgatcatgctcggcgacacgatgtcggggcggattggaggtcagatccacctggccataatggctgttttcaaaatgtccccgggctatgtgctaggggtctttctgagaaagctcacttctagggaaaccgccctgatggtgatcggaatggcaatgacaaccgtattcagcattcctcatgatcttatggagttgatcgacggcatttcactgggtttaatcctcctgcgtatagtgactcactttgataacacacaggtcgggacccttgctctgagtctaacattcattcgctccactaccccactcgttatggcctggcggacgatcatggcagtgttctttgtggtcacactgatccccttgtgtagaacctcttgcctgcaaaaacagagccattgggtggagattactgccttaatcctcggagctcaggcgctgcctgtttaccttatgaccctgatgaagggcgcctccaggcgatcatggcccttgaatgaaggcattatggcagtagggctcgtgagcctgctaggaagtgctctgcttaaaaacgacgtcccactcgccggtcctatggtggccggcgggctgttgctggctgcatacgttatgtctggatccagcgccgatttatcgctcgagaaggcggctaatgtgcaatgggacgaaatggccgatataacaggctcatctcccatcattgaggtcaagcaggacgaagatggtagtttctccatccgggacgtggaggagactaacatgattaccctgcttgtaaaactggcattgatcacggtcagcgggctctatccactggccataccggtgacaatggctctatggtacatctggcaggttaagacccagcgctctggagcactgtgggatgtgcctagccccgccgcgactcaaaaagctacactttccgaaggcgtctatagaattatgcagaggggcctctttgggaagacccaggtgggagttggtatccacatggagggcgtgttccacactatgtggcatgtcacacgggggtcagtgatttgtcacgaaaccggacgactggagccaagttgggccgacgtaagaaatgatatgatcagctacggcggtgggtggcgcttgggagacaaatgggacaaggaagaggatgtgcaggttttagcaatagagcccggcaagaaccctaaacatgtccaaacgaagccaggcctgtttaaaactctcaccggggaaattggagccgtgacactggacttcaagcccggtacctctggctcccctatcatcaataaaaaggggaaagtgattggactttatggcaacggtgtcgtaacaaagtcaggggattacgtgagtgctataactcaggccgagaggatcggagaaccggactatgaggttgatgaggacatttttcgtaagaaacggctgaccatcatggatttgcacccaggcgcaggcaagacgaaaagaattctacccagcatcgtgagggaagctctgaagcgccgactcagaacactgatacttgcccctactcgggtcgtggcggccgagatggaagaggcattaagggggctgccaatccgctaccagacccccgctgttaaatccgaacatacaggacgtgagattgtggacctcatgtgccacgccaccttcactaccagattgctgtcttcgacacgggtccctaattacaacctcatcgtgatggatgaggctcactttacggacccgtgcagcgtagcagccaggggttatatttcaactcgcgtggaaatgggcgaggccgctgcgatcttcatgaccgcaacacccccagggtccatagatccttttccccagagtaattctccaattgaagacatcgagcgagaaatccctgagagaagctggaacaccggattcgactggattactgattaccaaggcaagacagtttggttcgtcccctccatcaaggccggtaatgacatagctaactgtctgcggaaatcagggaagagggtgattcagctttctcgcaaaacctttgatacggagtatccaaagactaaactgacagactgggatttcgtggtcaccaccgacatcagcgaaatgggcgccaactttagagcaggaagggttattgatccgcggcgttgcttgaagcctgtgatcctaactgacggccccgagcgcgtaatactggccgggccaattcccgtgacacctgctagtgcggcccagcgaagaggaaggatcggtcggaatccagcacaagaagatgaccagtacgtcttctccggcgatcccctcaagaacgacgaggatcatgctcactggaccgaagccaaaatgttactggacaatatctatacacctgaggggattatcccgactctttttggaccagagcgcgaaaagacgcaggcaattgacggcgagttcagactgaggggtgaacagcggaaaacctttgtggagctcatgcgaagaggggatttgcccgtttggctgagctacaaggtggcctctgctggcatatcatataaagaccgcgagtggtgtttcacaggagaaaggaacaatcaaatcctcgaggaaaacatggaggtcgaaatttggactcgggagggcgagaagaagaaactgcgtcctaagtggcttgatgccagagtatacgcggaccccatggcactaaaagattttaaggaattcgcctccgggaggaaaagtatcaccctggacatcttgacagagattgctaccttaccaacttacctgagctcgaaggccaagctcgctctggataatatagtgatgcttcatacgaccgaaaaaggaggtcgcgcatatcagcacgccctgaacgagctccctgaatctttggagacactgatgctagttgctctgctcggcgcccttactgcagggatctttctgttctttatgcagggaaagggcattggtaaattatccatggggttgatcgcgattgccgtggctagcggcctgctctgggtcgccgagatccagccccaatggatagcagcttcaatcattctggaattcttccttatggtgctgctcatcccagagcctgaaaagcagcggaccccgcaggacaatcagttgatttacgtcatcctgacaatattaaccattatcggactaattgccgcaaacgagatgggcctgatcgaaaaaactaagacagattttgggttctatcaagtgaaaacggagaccactatactcgacgttgatcttcgacccgccagtgcttggacactgtacgcggtggccaccaccatcttgacaccaatgctgagacacactattgagaatacgtctgcaaacctctccctggctgccatcgccaatcaggcagctgtacttatgggactcggcaagggttggcctctgcataggatggacttgggggtgcccctgttagccatgggatgctatagccaggtcaacccaaccacactaactgcgtcactggttatgctccttgtgcactacgctattatcggccctggtctgcaggccaaggcaacccgcgaagcccaaaaacggacagctgcaggcataatgaagaatcccaccgtcgatgggattactgtgatcgacttggagccgatcagttatgacccaaaatttgaaaagcagctgggacaggtaatgctcctggtgctttgtgttggccaattactgctcatgagaacgacatgggccttgtgcgaggtgctgaccctagcgactgggcctattatgaccctgtgggagggaaaccccggccgtttctggaacacaactatcgctgtcagcaccgccaatatatttaggggttcctacctcgcaggggccggacttgctttctctctgattaaaaacgcccagacaccacggcgcggcacgggtaccactggcgaaacattgggggagaagtggaagcgacagctgaatagcctcgatagaaaagaatttgaggaatacaagaggtccggaatcctggaggtggaccggaccgaggcaaaatcagctttacgcgatggctctaagattaaacatgccgtcagtagagggtcgagcaagatcaggtggatagtggaacgaggaatgatcaagcccaaaggcaaggttgtagaccttggttgtgggcggggaggctggtcctattacatggcgactctgaaaaacgtgacagaggtcaagggctataccaaagggggacctggtcacgaagagccgattcccatggccacgtacggctggaatctcgtgaagctacattctggggttgatgtgttctataagccaaccgaacaggtcgacacactgttgtgcgatatcggagagtcaagctccaaccctactattgaggaaggccgtaccctgagagtgctcaaaatggtagagccctggcttagttctaagcctgaattttgtatcaaagtgctgaatccatacatgcccacagttattgaggaattggagaagctgcaacgcaggcacggtgggagcctcgtccggtgccctttatcaagaaactccactcacgagatgtattgggtgagtggagcaagcggcaatatcgtgtcttccgtcaacaccatatcaaaaatgctgcttaatcgcttcacaaccaggcatcgaaagccaacttacgaaaaagacgttgatctgggcgctgggacgcggagcgtgtcgacagagaccgaaaagcccgacatgactattatcggaagaaggctacagcgcctccgtgaggagcacaaggaaacctggcattacgatcaggagaacccgtatcggacatgggcctaccacggttcttatgaagcacctagtacgggctccgctagctcaatggtaaatggggtggtcaaactgttgaccaagccatgggacgtgatccccatggttactcagctggccatgacagacaccactccttttggacaacagagagtgttcaaagagaaggtcgatacaaggaccccacagcccaaaccgggcacacgcatgattatgactatgaccgccaactggctctgggcgcttctgggtaagaagaaatcccctcgattatgtacgcgggaagagtttatatctaaggtgagaagcaatgctgcaatcggggccgtattccaggaggaacaaggatggaccagtgcttccgaggccgttaacgacagcaggttctgggaactggtggataaagagcgcgcattgcaccaggaaggcaagtgcgagtcttgcgtctacaatatgatgggcaaaagagagaagaagctcggggaatttggacgggccaaaggttcaagggctatttggtatatgtggctgggcgcgcgtttcctagagtttgaagcccttgggttcctgaacgaggaccattggtttagtcgagaaaactcctggagcggagtggagggcgagggtctccaccgcctggggtacatcttggaagatattgacaagaaagatggagacctgatctatgcagatgacacagctggctgggatactagaataaccgaggacgatctccttaatgaagagctgatcacagagcagatggccccccatcacaagactttagcaaaagccattttcaagctgacctaccaaaacaaggtggtcaaagttttgcggccaacgcctaagggcgctgtgatggacatcatttctaggaaagaccagcgcgggtcgggacaggtaggtacatacggcctcaatacctttactaacatggaagtgcagctgatcagacaaatggaggccgaaggggtcataacacaggatgacatgcagaatccccggggactaaaggagagggtggaaaaatggcttaaggagtgtggcgttgatcgactgaaacgtatggcgatttcaggtgacgattgcgtggtcaagccaatcgacgagagattcagcacctccctcctgtttttgaacgatatggggaaggtgcgcaaagacatcccccagtgggaacctagtaagggatggaaaaattggcaagaggtaccattctgttctcatcactttcacaagattttcatgaaagatggccggagcttagttgtgccgtgcaggaaccaggacgaactgataggcagagcacgcatctcccagggggccggatggtcactccgggagactgcttgtcttggtaaggcctatgcacagatgtggagtctgatgtactttcataggcgagatctaagactggcttctatggccatttgcagcgctgtccccaccgaatggttccctacatcccggacgacctggtcaatccacgcccatcaccaatggatgactacagaggacatgctcaaggtgtggaatagggtttggattgaggacaacccaaatatgaccgataaaactcccgtgcacagctgggaagacatcccttatttgggcaagcgcgaggatctgtggtgtgggtctcttataggactgtccagtcgtgcaacatgggcgaaaaacatccataccgccattacgcaggtcagaaatctcatcggcaaggaagagtacgtggactatatgccagctatgaaacgatacagcgcccccttcgaatcggagggtgtattatga

SEQ ID NO: 15751 - RNA, 9867 nt, synthetic construct
  misc_feature 1..9867: note = derived and/or modified CDS sequence (opt3) from DENV-4__JF741967__SS-prME
  source 1..9867: mol_type = other RNA
agcaccatgacactgctctgccttatccccactgtgatggccttccacctgtccacgagagacggcgagcctttgatgattgtcgctaagcatgaaagggggcggccattactgtttaaaaccacagagggaataaacaagtgtactctaatcgcaatggatctcggtgaaatgtgcgaggacaccgttacatacaaatgtccgctgcttgtgaataccgaacccgaggatattgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtaacactcacgccgtcgggaatgataccagcaaccacggcgtgacagcaaccataactcctcgttccccatcagtagaggttaagttaccggactacggagaactgacgctcgattgcgagccccgcagtggcattgacttcaatgagatgatccttatgaagatgaaaaagaaaacatggctggtgcataagcagtggtttttggacctacctctgccatggaccgctggggccgatactagcgaagtccactggaactacaaagagagaatggtgaccttcaaggtcccccatgcgaaaaggcaggacgtgacagttctcggatctcaggaaggtgccatgcactccgcactggctggcgccaccgaggtggattcaggggacggaaatcacatgtttgctggccatcttaagtgtaaggtacggatggaaaaactgcgaattaagggtatgagctatactatgtgcagtgggaaattctctatcgataaggagatggccgagacacaacacggcacgaccgtcgtgaaagttaagtacgaaggagcaggcgccccttgtaaggtgccaatcgagattcgcgacgtcaacaaagaaaaggtggtagggagaataatctccagcactcccttcgctgagaacacaaattcggtgaccaacattgagttggaaccgccttttggagattcttatatcgttataggtgtcggcgactccgcgctcacactgcattggttcaggaaagggtcaagtattggaaagatgtttgagagcacttaccggggcgcaaaacgcatggccatcttaggtgaaaccgcttgggatttcgggtccgtgggcggactgtttacgtctctaggcaaggccgtgcaccaggtcttcgggagcgtttataccacaatgtttggaggcgtgtcatggatgatcagaattctcatcggtttcctggtgctttggattgggactaatagtaggaacacctccatggcaatgacatgcatagccgtaggaggcatcactttgtttctgggtttcaccgtccaggctgacatgggctgtgtggttagctggaatgggaaggagctcaaatgcggatctggcatttttgtggtcgataacgtgcatacgtggacagaacaatacaagttccagcccgagtcaccagcccgtctggcaagtgcgatccttaatgctcacaaagacggggtttgtggaatccggagcaccactcgactggagaacgtgatgtggaagcagattacaaatgaattgaactatgtactctgggagggcggtcacgacctgaccgtcgtggccggggatgtgaaaggagtcttaactaagggcaagagagcactgacccctcccgttaatgacctaaaatactcctggaagacatggggtaaagccaagatatttacgccagaagctaggaactctaccttcctcatcgatggccccgacacttcggagtgccctaatgaacgccgggcctggaacttctttgaggtggaggattacgggttcggaatgtttacaaccaatatttggatgaaattcagagaaggcagctccgaggtatgtgaccataggctgatgtcagcagctatcaaggatcagaaagccgtgcacgcggacatggggtattggattgaaagttctaagaaccaaacatggcagatcgagaaggccagccttatagaagtcaaaacttgcttgtggccaaagacccatacgctgtggtccaacggagtgctcgagtcacagatgctgatcccgcgcagctacgctggccccttttctcagcacaattatcgacaaggttacgcaacacagaccgccgggccttggcacttaggaaaactggagattgatttcggcgaatgcccaggtactaccgttacaatccaggaggactgtgatcatcggggcccctcccttcgtactaccacagctagtgggaagttggtgacgcagtggtgctgtagaagctgcaccatgcctccactcaggtttctgggagaagacggctgttggtatgggatggagattcgccccctatctgagaaagaagagaacatggtcaagtcccaagtgactgccggacagggcacatcagaaaccttcagtatgggtctgctctgcctgactctttttgttgaggaatgtttgcggagaagggtgacacgaaagcacatgatcctggcagtcgtaataaccttctgcgcgattatcttagggggactcacgtggatggatctgcttcgcgtgctgattatgttgggcgacactatgagcggccggatcgggggacagatacatctcgccatcatggctgtttttaaaatgtcgccgggttacgtgctgggcgtcttcctaagaaagctgacctccagggagacagccctcatggtgattgggatggcaatgaccactgtattttctatccctcacgacctgatggagcttattgatggaatcagcttgggcctgatattactcaaaattgtgacacatttcgacaatacccaggtcggtacactggctctttcactgactttcatccgtagtaccacgccactagttatggcctggcgcacaatcatggcagtgtttttcgtggtcaccctcattcccctgtgtcggacttcctgcttgcaaaagcagtctcactgggtggaaatcaccgccctgattttaggggctcaggcgctccctgtttatctgatgacacttatgaaaggagccagcagaaggtcctggcccctgaacgagggcataatggcagtaggcttggtgtcactcctggggagcgctctactgaagaatgatgtcccacttgccggacctatggtggccggtggcctcctgttggctgcatacgttatgagtgggtcttccgccgacctgagcttagaaaaggcggctaacgtgcaatgggatgagatggccgacatcactggatcgtcacccattatcgaagtcaaacaggatgaggacggctcttttagtattcgagaggtggaagagaccaatatgatcacgctcctggtaaagcttgcactgataacagtctccggtttgtacccactcgccatcccggtgaccatggctctgtggtatgtttggcaggtgaaaactcagcggagcggggcactatgggatgtcccttctcccgccgcgacacacaaggctaccctgagcgaaggagtgtaccgcattatgcaaagaggccttttcggcaaaactcaggttggggtgggaatccatatggagggtgtctttcacacagtgggccatgtaaccagggggtccgtgatttgtcacgaaacgggacggctcgagccatcatggggcgacgttcgaaacgatatgatcagttatggtgggggatggagactgggcgacaagtgggataaggaggaagacgtccaggtgttggccatagagcccggcaaaaatcctaagcatgtgcagactaaaccagggttattcaagaccctgacaggagaaattggtgcagtcaccctcgactttaaacccggcacaagcgggtctcctatcatcaacaagaaaggaaaggtaattggcctgtacggtaatggggtggttactaagtccggagattatgtgtcagccataacccaagctgagcgcatcggcgagccggactacgaagtcgatgaggacattttcaggaaaaagcgtcttacgatcatggatctgcacccaggcgccgggaaaacaaagcggattttgcccagtatcgtgagagaagcactaaaaaggcgcctgcgaactctcatactggctcctaccagagttgtggccgcggagatggaagaggcccttcggggattaccaatcaggtatcagacacccgcagtcaagagcgagcacaccggtcgcgaaattgtggacctgatgtgccatgctacttttaccacacgtctcttgtcctctacgagagtacctaactacaatctgatcgtgatggatgaggcccacttcactgacccgtgctcggttgctgcacggggctacattagcaccagggtcgaaatgggggaggccgccgctatctttatgacagcgacccccccaggatcaatagatcctttcccccagtccaacagtccaattgaagacatcgagcgcgagatccctgaacgatcttggaatactggcttcgattggattacagactatcagggtaagaccgtgtggtttgtgcccagcatcaaagcagggaacgacatagccaactgtctcagaaagtccggcaaacgggtcattcaactgtcaaggaagacgttcgatactgagtacccaaaaacaaagcttaccgactgggattttgttgtgaccactgacatctctgaaatgggagctaatttccgcgccggcagagtaattgatccgaggcggtgcctgaagcctgtgatcttgacagacgggcccgagcgtgtcatactagcaggaccaattcccgtgacccctgccagcgctgcgcagcgccgaggtagaatcggcaggaacccagcccaggaagatgaccaatatgtttttagtggggatcccctgaaaaatgacgaggatcatgcacactggacagaggctaagatgctcttagacaacatctacactcctgaaggaattatcccgacgctgttcggcccagagcgggaaaaaacccaggccattgatggtgagtttcgccttagaggggagcagaggaagacattcgtggaactgatgcggcgaggcgacctccccgtctggttgtcctataaagtagcaagcgccggaatatcttacaaggacagagagtggtgttttactggcgaacgcaataaccagatcctggaggaaaatatggaggtggagatttggaccagggaaggggagaagaaaaagctccggcctaaatggctggatgctcgtgtttatgccgaccccatggcgcttaaggatttcaaagaatttgcatcaggaagaaagtccatcacactagacatcctgaccgagattgccactttgccaacgtacttaagtagcaaggctaaactggccctcgataacatagtgatgctgcacaccacagaaaagggtggcagggcttaccaacatgcacttaatgagctgcctgagtcgctcgaaactttgatgctggtcgccctactgggggctatgaccgccggaatcttcctctttttcatgcagggcaaaggtattgggaagctttctatgggcctgatcgcaattgcggtggcctccggattattgtgggtcgctgagatccagccccagtggatagccgcaagcatcattctggaattctttctcatggtgctgcttatcccagagcctgaaaaacaacgcacaccgcaggacaaccagctgatttatgttatcctcaccatattgactattatcggcctgattgctgccaatgagatggggttaatcgagaagacaaaaacggatttcggattttaccaggtgaagcccgaaaccactatactagacgtagatctgcggccagcatcagcctggacactctatgctgtggcgaccaccatccttacacctatgctgcgacacactattgagaacacgagtgccaatttgtctctggcagctatcgccaaccaagccgcagtcctcatgggcctgggtaaggggtggccccttcatagaatggacctcggagttccactgttggctatgggctgctactcccaggtgaatcctaccacactgactgccagcttagtcatgctactggtgcactatgcgattatcggtcccggcctccaggctaaagccaccagggaagcacagaagcgcacagccgctgggataatgaaaaacccgaccgtagatggaattactgtgatcgaccttgagccaatctcatacgatcctaagttcgagaaacaactgggccaggttatgttgctggtgctctgtgtcgggcagctgcttttaatgcggacgacatgggcactgtgcgaagtgctcaccttggccactggacccgtcatgaccctgtgggagggcaacccaggtagattttggaatacaactattgcggtgagtaccgctaacatcttccgtgggagctatctagccggagcaggcctggccttttccctcataaagaatgctcaaacacccaggcggggtacgggcaccactggggaaacacttggagagaagtggaaacgccagctgaactctttggaccgaaaggaattcgaggagtacaaaagaagcggcattctggaagttgacaggaccgaggccaagtccgcactccgggatgggactaaaatcaagtacgctgtatcacgcggatctagtaagattagatggatcgtggaaaggggcatgataaaacctaagggtaaagtcgtggacctggggtgtggacgaggcggctggtcgtattacatggccacattaaagaatgttaccgaggtgaaagggtatacgaagggaggtccgggccatgaagagcccatcccaatggcgacctacgggtggaaccttgtcaagctgcacagcggagtggatgtattttataaacctacagagcaggtggacactctcctatgcgatattggcgaatcctcttcaaatcccaccatcgaggaaggtcggacactgcgtgttttgaagatggtcgagccttggctgagctccaaaccagaattctgtattaaggtgctcaacccctacatgcctactgtgatcgaggagcttgaaaaactgcagagacgccacgggggaagtttggtcaggtgcccactgtctcggaatagcacccatgagatgtattgggtttcaggcgcctccggcaacattgtgagtagcgtaaatacaatctctaagatgctcttaaacagatttaccactcgccacaggaaacccacgtacgaaaaggacgtggatctgggggcaggaacacgatccgtctcaaccgagactgagaagccggacatgaccgtgataggtcggagacttcaaaggctgcgcgaagagcataaagaaacatggcactacgatcaggagaatccttatcgtacgtgggcttaccacggcagctatgaagccccatcgaccgggtctgcaagttccatggttaacggagtggtcaagctactcactaaaccctgggacgtgattcctatggtaacacagctggctatgaccgatactacaccattcggccagcaacgggtttttaaggagaaagtggacaccagaacaccccagccgaagcctggtactaggatgatcatgaccacgaccgccaattggttgtgggccctgctcgggaagaaaaagagcccccgcctttgtacacgagaggaattcatctcaaaagtccggtccaacgcggctattggagcagtgttccaggaggaacagggctggacttctgccagcgaggctgtgaatgacagtagattttgggaactggtcgataaggagagggccttacatcaagagggcaaatgcgaatcctgcgtttacaacatgatggggaagcgcgagaagaaactgggagaattcggtagagcaaagggcagccgggccatatggtatatgtggttgggggctaggtttctcgagttcgaagcgctgggatttctaaacgaggaccactggttctctcgtgagaattcatggagtggcgtggaaggtgaggggcttcatcgactgggatacatcctcgaagatattgacaaaaaggatggcgacctgatctatgccgatgacaccgcaggctgggatacacgcattactgaggacgatttgctgaacgaggaactcatcaccgagcagatggctccacaccataaaacgcttgccaaggcaatatttaagctgacataccagaataaagtagtgaaggtcttaagacctacccccaaaggggccgtgatggacatcatttcccggaaggatcaaaggggaagcggtcaggttggcacttacgggctgaacacattcaccaatatggaagtgcagttgatccgccagatggaggctgaaggagtcattactcaagacgacatgcagaacccaaaaggcctcaaggagagagtggagaaatggctgaaggaatgtggtgtagatcggctaaagaggatggccatctctggggacgattgcgttgtgaaaccccttgacgagcgattttcgacctcactgctcttcctgaatgatatgggaaaggtccgtaaagacatacctcagtgggaaccaagcaagggctggaaaaactggcaggaggtgccgttttgttcccaccacttccataagatttttatgaaggatggcagaagtttggttgtgccctgccgcaatcaagacgaattaatcgggcgggcgaggatctctcagggagcaggttggagcctgagagagacagcctgtctcggcaaagcttatgcccagatgtggtcccttatgtacttccaccgccgggatctgaggctagcatcaatggctatttgcagtgccgtccctacggagtggttcccaacctctcgaactacatggagcatacatgctcaccaccagtggatgaccactgaagacatgctgaaggtgtggaacagagtatggatcgaggataatcccaacatgacagacaaaacccctgtgcattcctgggaagacattccatatctcgggaagcgggaggatttgtggtgtggatcactgatcggccttagctctagggccacgtgggcaaaaaatattcacacagcgatcacccaagtccgcaacctgataggtaaggaagagtacgttgactatatgcccgccatgaagcgttactccgctccttttgagagtgaaggggtgctctga

SEQ ID NO: 15752 - RNA, 9867 nt, synthetic construct
  misc_feature 1..9867: note = derived and/or modified CDS sequence (opt3) from DENV-4__JQ822247__SS-prME
  source 1..9867: mol_type = other RNA
agcaccatgaccctgctctgccttatccccactgtgatggccttccacctgtccacgagagacggcgagcctttgatgattgtcgctaagcatgaaagagggcggccattactgtttaagaccacagaggggataaacaagtgtactctaatcgcaatggatctcggtgaaatgtgcgaggacaccgttacatacaagtgtccgctgcttgtgaataccgaacccgaggatattgactgctggtgtaacctgacttctacatgggtgatgtatggaacctgcacgcagtcaggggagcgccgacgtgaaaagagaagtgtggccttgactcctcacagcggaatgggcctcgagaccagggcggaaacatggatgtcctctgagggtgcttggaagcatgcccaacgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtaacactcacgccgtcgggaatgataccagcaaccacggcgtgacagcaaccataactcctcgttccccatcagtagaggttaagttaccggactacggagaactgacgctcgattgcgagccccgcagtggcattgacttcaatgagatgatccttatgaagatgaaaaagaaaacatggctggtgcataagcagtggtttttggacctacctctgccatggaccgctggggccgatactagcgaagtccactggaactacaaagagagaatggtgaccttcaaggtcccccatgcgaaaaggcaggacgtgacagttctcggatctcaggaaggtgccatgcactccgcactggctggcgccaccgaggtggattcaggggacggaaatcacatgtttgctggccatcttaagtgtaaggtacggatggaaaaactgcgaattaagggtatgagctatactatgtgcagtgggaaattctctatcgataaggagatggccgagacacaacacggcacgaccgtcgtgaaagttaagtacgaaggagcaggcgccccttgtaaggtgccaatcgagattcgcgacgtcaacaaagaaaaggtggtagggagaataatctccagcactcccttcgctgagaacacaaattcggtgaccaacattgagttggaaccgccttttggagattcttatatcgttataggtgtcggcgactccgcgctcacactgcattggttcaggaaagggtcaagtattggaaagatgtttgagagcacttaccggggcgcaaaacgcatggccatcttaggtgaaaccgcttgggatttcgggtccgtgggcggactgtttacgtctctaggcaaggccgtgcaccaggtcttcgggagcgtttataccacaatgtttggaggcgtgtcatggatgatcaggattctcatcggtttcctggtgctttggattgggactaatagtaggaacacctccatggcaatgacatgcatagccgtaggaggcatcactttgtttctgggtttcaccgtccaggctgacatgggctgtgtggttagctggaatgggaaggagctcaaatgcggatctggcatttttgtggtcgataacgtgcatacgtggacagaacaatacaagttccagcccgagtcaccagcccgtctggcaagtgcgatccttaatgctcacaaagacggggtttgtggaatccggagcaccactcgactggagaacgtgatgtggaagcagattacaaatgaattgaactatgtactctgggagggcggtcacgacctgaccgtcgtggccggggatgtgaaaggagtcttaactaagggcaagagagcactgacccctcccgttaatgacctaaaatactcctggaagacatggggtaaagccaagatatttacgccagaagctaggaactctaccttcctcatcgatggccccgacacttcggagtgccctaatgaacgccgggcctggaacttctttgaggtggaggattacgggttcggaatgtttacaaccaatatttggatgaaattcagagaaggcagctccgaggtatgtgaccataggctgatgtcagcagctatcaaggatcagaaagccgtgcacgcggacatggggtattggattgaaagttctaagaaccaaacatggcagatcgagaaggccagccttatagaagtcaaaacttgcttgtggccaaagacccatacgctgtggtccaacggagtgctcgagtcacagatgctgatcccgcgcagctacgctggccccttttctcagcacaattatcgacaaggttacgcaacacagaccgccgggccttggcacttaggaaaactggagattgatttcggcgaatgcccaggtactaccgttacaatccaggaggactgtgatcatcggggcccctcccttcgtactaccacagctagtgggaagttggtgacgcagtggtgctgtagaagctgcaccatgcctccactcaggtttctgggagaagacggctgttggtatgggatggagattcgccccctatctgagaaagaagagaacatggtcaagtcccaagtgactgccggacagggcacatcagaaaccttcagtatgggtctgctctgcctgactctttttgttgaggaatgtttgcggagaagggtgacacgaaagcacatgatcctggcagtcgtaataaccttctgcgcgattatcttagggggactcacgtggatggatctgcttcgcgtgctgattatgttgggcgacactatgagcggccggatcgggggacagatacatctcgccatcatggctgtttttaaaatgtcgccgggttacgtgctgggcgtcttcctaagaaagctgacctccagggagacagccctcatggtgattgggatggcaatgaccactgtattttctatccctcacgacctgatggagcttattgatggaatcagcttgggcctgatattactcaaaattgtgacacatttcgacaatacccaggtcggtacactggctctttcactgactttcatccgtagtaccacgcccctggttatggcctggcgcacaatcatggcagtgtttttcgtggtcaccctcattcccctgtgtcggacttcctgcttgcaaaagcagtctcactgggtggaaatcaccgccctgattttaggggctcaggcgctccctgtttatctgatgacacttatgaaaggagccagcagaaggtcctggcccctgaacgagggcataatggcagtaggcttggtgtcactcctggggagcgctctactgaagaatgatgtcccacttgccggacctatggtggccggtggcctcctgttggctgcatacgttatgagtgggtcttccgccgacctgagcttagaaaaggcggctaacgtgcaatgggatgagatggccgacatcactggatcgtcacccattatcgaagtcaaacaggatgaggacggctcttttagtattcgagatgtggaggaaaccaatatgatcacgctcctggtaaaacttgcactgataacagtctccggtttgtacccactcgccatcccggtgaccatggctctgtggtatgtttggcaagtgaaaactcagcggagcggggcactatgggacgtcccttctcccgccgcgacacaaaaggctaccctgagcgagggagtgtaccgcattatgcagagaggccttttcggcaaaactcaggttggggtgggaatccacatggaaggtgtctttcatacaatgtggcacgtgaccaggggctccgtaatttgtcatgagacggggcggctcgaaccatcatgggccgatgtgcgaaacgacatgatcagttatggaggcggttggagactgggggataagtgggacaaggaggaggacgttcaggtcttggcaatagaacccggcaagaatcctaagcacgtgcaaactaaaccaggcttattcaagaccctgacaggcgagattggggccgtgaccctcgattttaaacccggaacaagcggttctcctatcatcaacaagaaaggcaaggtcattgggctgtacggaaatggcgtagtgactaagtccggtgactatgtttcagctataacccaggccgaacgcatcggggagccggattacgaggtggacgaagatattttcaggaaaaagcgtcttacgatcatggacctgcatccaggagcaggcaaaacaaagcggattttgcccagtatcgtcagagaggctctaaaaaggcgcctgcgaactctcatactggcccctaccagagtggttgcggccgaaatggaggaagcacttcggggcttaccaatcaggtatcagacacccgctgtaaagagcgagcacaccgggcgcgagattgtcgatctgatgtgccacgccacttttaccacacgtctcttgtcctctacgagagtgcctaactacaatctgatcgtaatggacgaagctcatttcactgatccgtgctcggtggcagcccggggatacattagcaccagggttgagatgggtgaagccgctgcgatctttatgacagcaacaccaccaggctcaatagaccctttcccccagtccaacagtccaattgaggatatcgaacgcgagatccctgagcgatcttggaatactgggttcgactggattacagactatcaaggaaagaccgtctggtttgtgcccagcatcaaagccggcaacgatatagctaactgtctcagaaagtccggtaaacgggtgattcagctgtcaaggaagacgttcgacactgaatacccaaaaacaaaacttaccgattgggactttgtcgttaccactgatatctctgagatgggggccaatttccgcgcaggcagagtgattgacccgaggcggtgcctgaagcctgtaatcttgacagatggacccgaacgtgtgatactagccggcccaattcccgtcacccctgctagcgcggcccagcgccgagggagaatcggaaggaacccagcacaagaggacgatcagtatgtgtttagtggtgaccccctgaaaaatgatgaagaccacgctcattggacagaggccaagatgctcttagataacatctacactcctgagggcattatcccgacgctgttcgggccagaacgggagaaaacccaggcaattgacggagaatttcgccttagaggcgagcagaggaagacattcgttgagctgatgcggcgaggtgacctccccgtgtggttgtcctataaagtcgccagcgctgggatatcttacaaggatagagaatggtgttttactggcgagcgcaataaccaaatcctggaagagaatatggaagtagagatttggaccagggagggagaaaagaaaaagctccggcctaaatggctggacgcccgtgtgtatgcggatcccatggcacttaaggacttcaaagagtttgcctcaggcagaaagtccatcacactagatatcctgaccgaaattgctactttgccaacgtacttaagtagcaaggccaaactggctctcgacaacatagttatgctgcacaccacagagaaaggtgggagggcataccagcacgcccttaatgaactgcctgagtcgctcgagactttgatgctggtggctctactgggggccatgaccgcaggcatcttcctctttttcatgcaggggaaaggaattggcaaactttctatgggtctgatcgcgattgccgtcgcttccgggttattgtgggtggccgaaatccagccccaatggatagcagctagcatcattctggagttctttctcatggtcctgcttatcccagaacctgagaaacagcgcacaccgcaggataaccagctgatttatgtgatcctcaccatattgactattatcggcctgattgccgcaaatgaaatgggattaatcgagaagacaaaaacggacttcggcttttaccaagttaagcccgagaccactatactagatgtggacctgcggccagcctcagcttggacactctatgcggtagccaccaccatccttacacctatgctgcgacatactattgaaaacacgagtgcaaatttgtctctggctgccatcgccaaccaggcagctgtgctcatggggctgggaaagggctggccccttcacagaatggatctcggtgtcccactgttggccatggggtgctactcccaggttaatcctaccacactgactgcgagcttagtgatgctactggtccattatgctattatcggacccggcctccaggccaaagcaaccagggaggcccaaaagcgcacagctgcaggtataatgaaaaacccgaccgtggacggcattactgtaatcgatcttgaaccaatctcatacgaccctaagttcgagaaacagctgggacaggtgatgttgctggttctctgtgtgggacaactgcttttaatgcggacgacatgggccctgtgcgaggtcctcaccttggcgactggccccgtgatgaccctgtgggaagggaacccaggaagattttggaatacaactattgctgtcagtaccgccaacatcttccgtggcagctatctagccggtgcagggctggctttttccctcataaagaatgcccagacacccaggcggggaacgggcaccactggtgagacacttggcgaaaagtggaaacgccagctgaactctttggaccgaaaggagttcgaagagtacaaaagaagcgggattctggaggtggataggaccgaagcaaagtccgctctccgggacggaactaaaatcaagtacgccgtttcacgcggctctagtaagattagatggatcgtagagagggggatgataaaacctaagggaaaagtggtcgatctgggctgtggtcgagggggatggtcgtattacatggcgacattaaagaatgtgaccgaagttaaaggctatacgaagggcgggccgggacacgaggaacccatcccaatggccacctacggttggaaccttgtgaagctgcatagcggcgtcgacgtgttttataaacctacagagcaggtagatactctcctatgcgacattggggagtcctcttcaaatcccaccatcgaagagggacggacactgcgtgtgttgaagatggttgaaccttggctgagctccaaaccagagttctgtattaaggtcctcaacccctacatgcctactgtgatcgaggaacttgagaaactgcaaagacgccacggcggtagtttggtgaggtgcccactgtctcggaatagcacccacgaaatgtattgggtctcaggggcatccggaaacattgttagtagcgtgaatacaatctctaagatgctcttaaacagatttaccactcgccataggaaacccacgtacgagaaggatgtagacctgggcgctggcacacgatccgtgtcaaccgaaactgagaagccggatatgaccgtcatagggcggagacttcagaggctgcgcgaggaacacaaagagacatggcattacgaccaggaaaatccttatcgtacgtgggcctaccacggaagctatgaggcaccatcgaccggttctgctagttccatggtgaacggcgttgtgaagctactcactaaaccctgggatgtcattcctatggtgacacagctggccatgaccgacactacaccattcgggcaacagcgggtatttaaggaaaaagttgacaccagaacaccccagccgaagcctggaactaggatgatcatgaccacgaccgccaattggttgtgggcgctgctcggcaagaaaaagagcccccgcctttgtacacgagaggagttcatctcaaaagtgcggtccaacgctgcaattggtgccgtcttccaggaggaacaggggtggacttctgctagcgaagccgtgaatgatagtagattttgggagctggtggacaaggaaagggcattacaccaggagggaaaatgcgagtcctgcgtctacaacatgatgggcaagcgcgaaaagaaactgggcgagttcgggagagccaagggaagccgggctatatggtatatgtggttgggtgcgaggtttctcgagttcgaggccctgggctttctaaacgaagatcattggttctctcgtgaaaattcatggagtggggttgagggagaaggccttcaccgactgggttacatcctcgaggacattgataaaaaggacggggatctgatctatgcagacgataccgctggatgggacacacgcattactgaagatgacttgctgaacgaggagctcatcaccgaacagatggccccacatcacaaaacgcttgcaaaggccatatttaagctgacataccaaaataaagtggtaaaggtgttaagacctacccccaaaggcgctgtcatggatatcatttcccggaaggaccagaggggcagcggacaggtgggaacttacggtctgaacacattcaccaatatggaggttcagttgatccgccaaatggaagccgagggcgtgattactcaggacgatatgcagaacccaaaagggctcaaggaaagagtcgagaaatggctgaaggagtgtggagtggaccggctaaagaggatggcgatctctggcgatgactgcgtagttaaaccccttgatgaacgattttcgacctcactactcttcctgaatgacatgggtaaggtgcgtaaagatatacctcagtgggagccaagcaaggggtggaaaaactggcaagaagtcccgttttgttcccatcacttccacaagatttttatgaaggacggaagaagtttggtggttccctgccgcaatcaggatgagttaatcggccgggcaaggatctctcagggcgccgggtggagcctgagagaaacagcttgtctcggaaaagcctatgcacagatgtggtcccttatgtacttccatcgccgggacctgaggctagcttcaatggccatttgcagtgctgtgcctacggagtggttcccaacctctcgaactacatggagcatacacgcccatcaccaatggatgaccactgaggatatgctgaaggtctggaacagagtgtggatcgaagacaatcccaacatgacagacaaaacccctgtacactcctgggaggatattccatatctcggtaagcgggaagacttgtggtgtggctcactgatcgggcttagctctagggcaacgtgggcgaaaaatattcatacagccatcacccaggtgcgcaacctgataggaaaggaggaatacgtcgattatatgcccgctatgaagcgttactccgccccttttgagagtgagggcgttctctga

SEQ ID NO: 15753 - RNA, 9867 nt, synthetic construct
  misc_feature 1..9867: note = derived and/or modified CDS sequence (opt3) from DENV-4__JF262783__SS-prME
  source 1..9867: mol_type = other RNA
agcaccgtgaccctgctctgccttatccccactgtcatggccttccacctgtccacgagagacggcgagcctttgatgattgttgctaagcatgaaagggggcggccattactgtttaaaaccacagagggaataaacaagtgtactctaatcgccatggatctcggtgaaatgtgcgaggacaccgtgatgtacaaatgtccgctgcttgtaaatacagaacccgaggatattgactgctggtgtaacctgacctctacttgggtgatgtatggcacatgcacccagtcaggggagcgccgacgtgaaaagagaagtgtcgccttgacgcctcacagcggaatgggcctcgagactagggcggaaacctggatgtcctctgagggtgcttggaaacatgcccaacgggtggagtcgtggatcctgcgcaatccagggttcgcactgctcgccggatttatggcttacatgattggccagacaggcatccagagaactgttttctttgtgttaatgatgctggtcgcaccctcatatgggatgaggtgtgtgggagtaggtaaccgggatttcgttgaaggcgtgagcgggggagcctgggtcgaccttgtgttggagcacggcggttgcgtgaccacaatggctcaggggaagcctaccctggattttgaactaataaagacgactgccaaagaggtcacactcctgcgcacctactgtatcgaagcgagtatttccaatatcactacagcaacccgatgcccaacgcaaggagagccctatcttaaggaggaacaggaccagcagtacatttgtagaagggatgttgtggaccggggctggggcaacgggtgcggactgttcggtaaaggcggggtagtgacctgcgccaagtttttgtgttctggaaaaatcacaggcaatctcgtccaaatagagaacctggaatatactgtggttgtgaccgtccataatggtgatacacacgtggtagggaaggacactagcaaccacggcgttaccgctacaattacccctcgttccccatcagtggaggtcaagttaccggattacggagaactgactctcgactgcgagccccgcagtggcatcgacttcaatgagatgattcttatgaaaatgaagaaaaagacgtggctggtgcataaacagtggtttttggatctacctctgccatggacagccggggcagacaccagcgaagtccagtggaactacaaggagagaatggtgactttcaaagttccccacgctaagaggcaggatgtgaccgtactcggatctcaagaaggtgccatgcattccgcgctgacaggcgccaccgaggtcgactcaggggatggaaatcacatgtttgcaggccaccttaagtgtaaagtgcggatggaaaagctgcgaatcaaaggtatgagctatactatgtgcagtgggaagttctctatcgacaaagagatggctgagacacagcatggcacgaccgttgtgaaggtcaagtacgaaggagccggcgctccttgtaaagtgccaattgagatacgcgatgtaaacaaggaaaaagtggttgggagaatcatttccagcactcccttcgccgagaatacaaactcggtcaccaacatcgagttggaaccgccttttggagactcttatatagtgattggtgtgggcgattccgcactcacactgcactggttcaggaaggggtcaagtatcggaaaaatgtttgagagcacttaccggggcgccaagcgcatggctatcttaggtgaaaccgcgtgggacttcgggtccgtcggcggactgtttacgtctctaggcaaggcagttcatcaggtgttcgggagcgtgtataccacaatgtttggaggcgtatcatggatggtcaggattctcatcggtctgcttgtgttgtggattgggactaatagtaggaacacctccatggccatgacatgcatagctatcggaggcattactctgttcctcggttttaccgttcacgccgatatgggctgtgcagtgagctggtctgggaaagagctgaagtgcggatcaggcatcttcgtcatcgacaatgtgcatacgtggacagaacaatacaaatttcagcccgagagtccagcccgtcttgctagcgccattctgaacgcacacaaggacggggtttgtggaatacggtccaccactcgattggagaatgtgatgtggaaacagatcacaaacgaactcaattatgtactgtgggagggcggtcacgatttaaccgtcgtggcgggggacgtgaagggagtcctgactaagggcaaaagagctctaacccctcccgttaacgatctcaagtactcttggaaaacatggggtaaggccaaaattttcacgccagaagcaagaaattcgacctttctgatcgacggccccgatactagcgagtgccctaacgaacgccgggcctggaatttccttgaggtggaggactacgggttcggaatgtttgctacaaacatttggatgaagttcagagaaggctcctcagaggtatgtgatcataggttgatgagtgccgcaatcaaagaccagaaggctgtgcacgccgatatggggtattggatagaatctagcaagaatcaaacctggcagatcgagaaagcgtccctgattgaagtcaagacatgcctctggccaaaaactcataccctgtggtcaaacgaggtgttagagagccagatgctgatcccgaaggcctacgctggacccttttctcagcacaattatcgccaaggctacgcaacgcagacaattggtccttggcaccttgggaaattggaaatcgacttcggagagtgcccaggcaccactgttaccatacaggaagattgtaaccatcgaggtccctccctccggacaactaccgccagtggcaagctggtgacacagtggtgctgtcgtagctgcacgatgcctccactaagatttctgggggaggacggatgttggtatggcatggagattaggcccctctctgaaaaggaggaaaacatggtcaaatcccaagtgtcagctgggcagggaaccagtgagactttcagcatgggcctgctttgcttgacactgtttgttgaagagtgtttacgccggagagtgaccaggaagcacatgatcctcgtcgtagtgactacactgtgcgccattatccttggtgggctgacctggatggatttgctccgagcactgataatgctaggagacacgatgtcgggccgcatgggcgggcagatccatctgactattatggcggttttcaaaatgtccccgggatacgtgctcggtgtctttctgcggaaacttacctctagagagacagccttgatcgtgattggcatggctatgaccactgtactgagcatccctcacgacttaatggagttcatagatgggatttcactcggactgatccttctgaaaatggtggcccattttgacaatacacaggtcggcaccctagcactcagtctgacattcatcaggtccactatgccattggttatggcttggcgtaccattatggccgtgctgtttgtggtcacgttaatccccctctgtcgcacatcttgcctgcaaaagcagagccactgggtggagattaccgcacttatactgggtgcccaggctttgcctgtttatctcatgactctgatgaagggggcgtccaaacggtcatggcccctaaacgaaggaatcatggccgtaggcctggtgagccttctcggcagtgcactgttgaagaatgatgtcccactggctgggcctatggtggccggaggtttactcctggccgcttacgttatgtctggctccagcgcagacctttcgctggagaaagccgcgaacgtgcaatgggatgaaatggctgacattaccgggtcatctcccatcattgaggtcaagcaggatgaggacggaagtttctccatcagagatgtggaagagacaaatatgataactttgctcgtaaaactggccctaatcaccgtcagcggcctgtacccacttgcaattccggtgacgatggccctctggtatatgtggcaggttaagacacagaggtctggtgctctgtgggacgtgcctagccccgcagccgcgcaaaaggctaccttgactgaaggggtctaccgaatcatgcagcggggattattcggcaaaacacaggtgggcgttgggattcacatggagggagtgtttcataccatgtggcacgtcactcgcggttccgtgatctgtcatgaaacaggcagactggagccatcatgggccgatgtaaggaacgacatgataagttatgggggaggctggcggctcggtgataagtgggacaaagaggaagacgtgcaggttctggcaattgagcccgggaagaatcctaaacacgtccaaaccaagccaggacttttcaaaacgctgactggcgaaatcggcgccgtgaccttggattttaagcccgggacaagcggatctcctatcattaacaagaaaggtcgagtgataggcctatacgggaatggaatcgtcaccaagtccggcgactatgtatcagctattacacaggccgagagaatcggtgagccggattacgaagtggacgaggatattttccgcaaaaagaggctgactgttatggacctccatccaggggcaggaaaaaccaagcgtatcctgcccagtatagtgcgggaagctcttaagagaaggttacgcacgctgatcctcgcccctacacgagtcgtggcggccgagatggaagaggcattgagaggcctgccaattcggtatcagactcccgctgttaaaagcgagcacaccggcagggaaatcgtggatctcatgtgccacgccacatttaccactcgcctgctttcctctacccgtgtccctaactacaatctgattgtgatggacgaggctcatttcacagatccgtcgagcgtagcagccagagggtacatctcaacgcgggtggaaatgggagaggccgctgcgatatttatgactgcaacacccccaggtgccacagaccctttcccccagtccaacagtccaattgaagatatcgagagggagatccctgaacgctcttggaataccggctttgactggattactgactatcaagggaagacagtttggttcgtccccagcatcaaagctggaaacgatatagccaattgcttgcgaaagtccggcaaaaaggtgattcagctatcaagaaagacctttgacacggagtacccaaaaactaagctgacagattgggacttcgtggtcaccaccgatatctctgaaatgggtgcaaacttccgggccaggcgcgttattgacccgagaaggtgtctcaaacctgtgatcttaactgatgggcccgagcgggtaatactggctggcccaattcccgtgacccctgcgagcgccgcacagcgtcgcggacgaatcggcagaaacccagctcaagaagacgatcagtatgtctttagtggggacccccttaagaatgatgaggaccacgcccattggacagaggcaaaaatgctgctcgataacatctacacacctgaaggaattatcccgactttgttcggtccagagagggaaaagattcaggccatagacggcgagtttcggctgcgcggggagcagagaaagacgttcgtggaactcatgaggcggggagacctgcccgtttggctttcctataaagtggctagcgccggcatctcttacaaggatcgagagtggtgctttaccggtgaaagaaataaccaaattctagaggaaaatatggaggtcgagatctggacacgcgaaggggagaaaaagaaactgaggcctaagtggttggacgcgcgggtatatgcagatcccatggccttaaaggacttcaaagaatttgcttcaggccgtaagtccatcactctggatattctcaccgagatagccagtctgccaacataccttagctcgagagctaaactggcactcgacaacatcgtgatgttgcacaccactgaaaggggaggccgcgcctaccagcacgctctgaatgagctacctgagtctctggaaacgctcatgcttgttgccctgttaggggcaatgaccgcgggaattttcttgtttttcatgcagggtaagggcatcgggaaactgtccatgggactcatggccattgctgtggccagcggcctgctttgggtcgcagagatccagccccaatggatagctgcctcaatcattctggaatttttcctcatggcattgctgatcccagagcctgaaaagcagcggacaccgcaggataaccagttaatttatgtgatcctaactatactgaccattatcggtctcattgccgctaatgagatggggcttatcgagaaaacaaagaccgactttggcttctaccaagtcaagactgaaacaacgatactggatgtggacttgcgacccgcgagtgcctggaccctgtatgcagttgctactacaatcctcaccccaatgctgagacataccattgagaacacatctgccaatctttccctcgccgcaatcgctaaccaggccgcggtgctgatgggattgggcaaagggtggcctctgcacaggatggatttaggagtacccctactggctatgggctgttacagccaggtgaatccaactacgctcaccgcctcacttgtcatgctgagtgttcattatgcaattatcggtcctgggttgcaggccaaggctacacgcgaagcacaaaaacggactgccgcgggaataatgaagaaccccaccgtggacggcattacagtcatcgatctggagccgatcagctacgacccaaaattcgagaagcagctcggtcaggtgatgctgcttgctttatgcgccggccaactgctcttgatgagaaccacttgggcattttgtgaagtactgacgctagccacagggcctattctgaccctctgggagggaaatcccggccgtttctggaacactaccatcgctgtgtccacagccaacatatttagggggtcttatcttgcaggagctggcctggccttcagcttgattaagaatgcgcagactccacggcgcggtaccgggacaacgggagaaaccctgggcgagaaatggaagcgacagctcaactccctggacagaaaagaatttgaggagtacaagaggtcaggtatcttagaagttgatcggactgaggccaaatctgcacttaaggacggcagtaagattaaacacgctgtgtcgcgcgggagctccaagatcagatggatagtcgaaaggggaatggtgaaacccaagggcaaagtcgtggatctggggtgcggacgaggcggttggtcttactatatggccacactcaagaatgttaccgaggtaaaggggtacactaaaggaggccctggccatgaagaaccgatccccatggcaacatatgggtggaacctagtgaagctgcactcaggagtcgacgtgttctacaaaccaaccgagcaggttgatacgttgctgtgtgacattggtgaaagctccagtaatcctaccatcgaggaaggccggacactccgtgtgcttaagatggtcgagccctggctgtctagcaaacctgaattttgcattaaggtgttgaacccatatatgcccactgtaatcgaggagctggaaaaactccaaagaaagcacgggggatcattagtgcgctgtcctctgtccaggaatagtacccatgagatgtactgggttagcggcgcttctggtaacattgtctcctcagtgaatacaactagcaagatgcttctgaaccggttcaccacaagacaccgcaaaccaacctatgaaaaggatgtgaatctaggggccggaactaggtcggtctctacggagacagagaaacccgacatgaccatcataggccgacggctccagagactgagggaagaacataaggaaacttggcactacgatcaggagaacccgtaccgcacctgggcctatcacggcagttacgaagcgccttccacagggagcgcttcatccatggttaatggagtggtaaaattgctgacgaagccatgggacgtgattcccatggtcacccagctcgcaatgactgatacaaccccttttggtcaacagcgtgtgttcaaggagaaagttgacactcggacaccacagcccaagccgggcaccagaatggtgatgacaactaccgccaactggctttgggctctgttagggaaaaagaaatctcctaggctgtgcacgcgcgaggaatttatcagcaaggtccgaagtaatgccgcaatcggagccgtgttccaggaggaacaaggctggacctccgctagcgaggcggtaaacgactctcggttttgggaattggttgataaggagagagccctccatcaggagggtaaatgtgaatcatgcgtgtataatatgatggggaagagggagaaaaagctgggagagttcggccgcgcaaaaggcagtagagctatttggtacatgtggctaggggcccggttccttgagtttgaagcactgggattcctcaacgaggaccactggtttggtagggagaactcctggagcggcgtcgaaggggagggactgcatcgtttgggctatatactggaagatatcgacaagaaggatggtgacctcatttacgccgatgacacagctgggtgggatactcgaatcaccgaggacgatcttctgaatgaggaattaattacagagcagatggcaccccaccatcgcatcctggcgaaagcaatattcaagttgacttatcaaaacaaagtggtgaaggtcctcagaccaacccctaaaggagccgttatggacatcatttctcggaaggatcagaggggctcgggccaggtggggacgtacggactgaatacatttaccaacatggaagtacagctaatccgccaaatggaggctgaaggtgtgattactcaggacgacatgcagaatcccaaaggccttaaggagagagtcgagaagtggctgaaagaatgcggggtggatcggctcaagaggatggccatctcaggagacgattgtgttgtgaaaccactggacgagcgattcagcacatccttgttatttctgaacgatatgggcaaggtccgtaaagacataccccagtgggaacctagtaagggttggaagaattggcaagaggtgccattctgctctcaccactttcataaaattttcatgaaggatgggagaagcctcgtagttccgtgtcgcaaccaggacgaacttatcggacgggcaaggatctcccagggcgctggctggtcactgagagagaccgcctgcctagggaaggcttacgcccagatgtggagtctgatgtattttcaccgccgggatctcaggttggcatctatggcgatttgtagcgccgtgcccactgagtggttccctacctcccgaacaacgtggtcaatacatgctcaccaccaatggatgaccactgaagacatgctgaaggtctggaatagagtgtggatcgaggataacccaaatatgacagacaaaacccccgttcatagctgggaagacattccttaccttggaaagcgggaggatctgtggtgcggttctctcatcggcttatccagtagggccacttgggcaaagaacattcacacagctatcacccaggtgcgcaatctgatagggaaagaagagtatgtcgactacatgccagtgatgaagcgttatagcgccccctttgagtcggaaggagtattgtga

SEQ ID NO: 15754 - RNA, 9867 nt, synthetic construct
  misc_feature 1..9867: note = derived and/or modified CDS sequence (opt3) from DENV-4__KU513441__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaagagtggtagggagggtgatctccgccacacccttggctgagaacaccaacagcgttacaaatattgagctcgaaccgcctttcggagactcgtatatcgtcataggtgtgggcaactctgcgctgactttacattggtttcggaaggggtcctcaattggaaaaatgttcgagagtacctaccgcggcgcaaagagaatggccatcctgggtgaaacggcttgggattttgggagcgtgggcggactattcacctccctcggcaaagccgtccaccaggtttttgggtctgtgtatacaactatgttcggaggcgtgagctggatgatcaggattctgatcggttttcttgtattgtggattgggaccaattcacgtaacacaagtatggcaatgacttgcatagccgtcggaggcatcaccctgttcctcggttttacggtgcaggctgacatgggctgtgttgtgtcctggagcgggcgggagctgaagtgcggatctggcattttcgtcgtggataatgttcatacatggaccgaacaatacaagtttcagcccgagtcaccagcccgacttgcaagtgcgatcctgaacgctcacaaagacggggtgtgtggaatcagaagcactacaaggttggagaatgtaatgtggaagcagattaccaacgaactcaattatgtcctgtgggagggcggtcacgacttaactgtggtggccggggatgtcaaaggagttctgaccaagggcaaacgcgcactaacacctcccgcctccgacctcaagtactcttggaagacgtggggtaaagctaagatattcaccccagaagcccggaactcgacttttctgatcgatggccccgacacaagcgagtgccctaatgaaagaagggcatggaactccttcgaggtggaggattacgggttcggaatgtttaccacaaatatttggatgaaattccgcgaaggctcaagtgaggtatgtgaccatcgacttatgtctgctgccatcaaggatcagaaagcggtgcacgccgacatggggtattggattgaaagctccaagaaccaaacttggcagatcgagcgggcttcattgatagaagtcaaaacctgcctgtggccaaagacgcatacactctggagcaatggagtgctggagtctcagatgttaatcccgaagtcctacgcaggcccctttagtcagcacaactatcgtcaaggttacgccacccagactgttgggccttggcacctgggaaaacttgagattgatttcggcgaatgcccaggtaccacagtgactatccaggagaactgtgaccatagaggccccagcttgaggaccacaacggcttctgggaagctcgtcacccagtggtgctgtcgctcctgcactatgcctccactgcggtttctaggagaagatggctgttggtatgggatggagattagacccctgtcagagaaagaagagaatatggtgaagagtcaagttacagccggacagggcaccagcgaaactttctcgatgggtctcctgtgccttacattgtttgtggaggaatgtctgaggcgacgcgtcacccggaaacacatgatcttagcagtagtgataacgctctgcgcgattatcctggggggacttacttggatggacctgttgagagccctcattatgctgggcgataccatgtccggcaggatcgggggacagacacatctagctataatcgccgttttcaagatgtctccgggttacgtgctgggcgtctttctccgtaagctgaccagccgcgagactgcacttatggtgattgggatggctatgacaaccacattgtcaatccctcacgacctgatggagttaattgacggaatcagtctcggcctgatacttctgaaaattgtaactcagttcgataacacccaagtgggtacgctagccctctccctgacatttatccggtctaccatgagcttggtcatggcatggagaactatcatggccgttctgttcgtggtgaccttaattccactctgtaggacatcctgcctgcagaagcagtcacattgggtcgaaatcactgctcttattctgggggcgcaagccttgcccgtgtatctcatgaccctgatgaaaggagcaagccgacggagttggcctctaaatgagggcataatggctgttggcctggtatctcttctcgggtccgccctgttgaagaacgacgtgcccctggccggaccaatggtcgctggtggcttactcctggcagcctacgtgatgagcgggtcgtcagcggatctttctctggaaaaagctgccaatgttcagtgggacgagatggcagatatcacgggaagttcccctattatcgaagtgaagcaggacgaggatggcagcttttctattcgcgacgtcgaggaaacaaacatgatcaccttgctcgtgaagctggccctaataactgtaagcggtctgtacccccttgctatcccaattacaatgaccctctggtatatgtggcaggtcaaaactcaaagatccggggcactgtgggatgtgccgtcacctgccgcgacacagaaggctgccttgagtgagggagtttacaggatcatgcagcggggcttattcggcaaaacccaggtgggggtcggaattcacatggaaggtgtgttccacacgatgtggcatgttactcgaggcagcgtgatctgtcacgagaccgggagactggaaccctcttgggcagacgtccgcaatgatatgatatcctatggaggcggttggaggctcggggacaagtgggataaagaggaggacgtgcaagtactggccattgaaccaggaaagaaccccaagcatgtgcagacaaaacctggcctttttaagaccctgacaggcgagatcggggctgttactttggacttcaaaccaggaacctcaggtagtcccatcattaatcgtaagggcaaagtcatagggctatacggaaacggcgtggtgacgaagagcggtgattatgtctccgccatcacacaggcagaacggattggggagcctgactacgaggtagatgaagacatctttagaaaaaagaggctgactattatggatctccacccgggagctggcaagaccaaacgcatcctgccatctatagtgcgagaggcccttaagagacggttaaggacactgatcctcgcgcccacccgcgttgtggccgcagaaatggaggaagctttgcgtggcctgcctattagatatcagactccagccgtcaaatcggagcataccgggcgggagatcgtggacctcatgtgccacgctacattcacgactaggctgcttagctcaacccgcgttcccaattacaacctgattgtgatggatgaagcacactttacagacccttccagtgtcgccgcccgaggatacatctctaccagagtggagatgggtgaagctgcggcaatattcatgactgccacaccgcccggcgctaccgatccatttcctcaaagcaattcccccattgaggacatcgaacgggagatcccagagaggtcatggaacacggggttcgattggattactgactatcagggaaagacagtatggtttgtgccttctatcaaagccggcaatgacatagcaaactgcttgcgcaagagcggtaagaaagttattcagctaagtagaaagaccttcgataccgaataccccaaaactaagctgacagactgggattttgtcgtgaccacagacatctccgagatgggggccaacttcagggctggccgggtgattgatccacgtcgctgtctcaaaccggtcatcttaactgacggacctgaacgagttatactggcgggccccattccagtgacgcccgccagcgcagctcaaagaagggggcggatcggacgcaatcctgcccaggaggatgaccagtatgtattctctggtgatccacttaagaacgacgaagatcatgcacactggaccgaggccaagatgctgctcgacaatatctacacacccgagggcattatccctactttgtttgggccggaaagagagaaaacccaggctattgatggagaattcaggctgcggggcgagcaacgaaagacatttgtggagctcatgagacgcggtgacctgccagtctggctttcatataaagtggcctccgcggggataagttacaaggacagggaatggtgcttcaccggcgagcggaacaatcagatcctagaagagaacatggaagttgagatttggactcgtgagggagaaaaaaagaagctgagacccaaatggttggatgcaagggtgtatgccgaccctatggctttaaaggattttaaagagttcgccagcggccgcaagtcgatcacgctggacatcctcaccgaaattgcttctctgcccacatacctttccagccgggcaaaactggccctcgataatatagtcatgttgcatactaccgagcgagggggaagagcttaccagcacgccctgaacgaactaccagagtcactggagacactcatgcttgtagcactgttaggtgcgatgaccgccggcatctttttgttctttatgcaggggaagggaattggcaagctgagtatgggtctcatcactattgctgtggcctctgggctgctttgggttgcagaaatccaacctcagtggatagctgcctccatcattctggagttctttctcatggtgttgctgatccccgaaccagagaaacagaggacacctcaggacaatcaattaatttatgtcatcctaacgatactgaccattatcggcctcattgcagccaacgaaatgggacttatcgagaagactaaaacagatttcggcttttaccaggtgaagaccgagaccacaatactggacgtcgatttgcgcccggctagcgcgtggactctgtatgccgtggcaacgaccatcctcacacccatgctgcggcacactattgaaaatacctcagctaaccttagtctcgccgccatcgcaaatcaggctgccgttctgatggggttgggaaaaggctggccactgcatagaatggacttaggtgtgcctctactggcgatggggtgttacagccaggtaaaccccacaaccctcactgcttcccttgtgatgctgttggtccactatgccattatcggaccaggcctgcaagcaaaggccacgcgtgaggctcagaaaaggacagcagccggtataatgaagaatcctaccgttgatggcattactgtgatcgacctcgaacccatctcttacgatccgaagttcgagaaacagctggggcaagtcatgcttttagtgctgtgcgcgggacagctcttgctgatgcggaccacatgggctttctgtgaggtactaactctggccaccggcccaattctcacactttgggaagggaaccctggacgcttttggaacacgaccatcgcagtgagcactgccaatatattccgaggctcctatctggctggtgccgggttggcattttcactgattaagaacgctcagacacccagaaggggaaccggcactgccggtgagacactcggcgaaaaatggaagcggcagctgaattctttagaccgcaaagagttcgaagagtacaagagaagtgggatccttgaggttgacaggaccgaagcgaagtcggccctgaaagatggaagcaagattaaacatgcagtgtcccgaggctcttcaaagatccggtggatagtcgagcgtgggatggtgaaaccaaagggaaaggtcgtggacctcggctgcggtagagggggatggagctactatatggctacgctaaaaaacgttaccgaagtaaagggctacacaaaaggcgggcccggacacgaggaacctatcccgatggccacttatggttggaatctggtgaagttgcattccggcgtcgatgtgttttacaaacccaccgagcaagttgacacactgctctgtgatattggggagagttctagcaacccaactatcgaagagggacgcacccttagggtgctgaagatggtcgaaccttggttgtcatccaagcccgagttctgcattaaagtgctgaatccttatatgccaacagtaatcgaagagctcgagaagttacagcggaaacacggcggtaacctggtgagatgtccccttagtcgcaatagcacccacgaaatgtactgggtttctggggcatccggaaacattgtctcaagcgtgaatactacgtcgaagatgctgctaaacaggtttacaacccgacatcggaaacctacttatgagaaggacgtggatctcggcgctggcaccagatctgtcagtacagaaatcgagaaaccagacatgacgataattgggaggcgcctgcagcgtttgcaggaggaacacaaggagacctggcattacgatcaagaaaatccctaccggacttgggcctatcacggatcctacgaggccccgagcacaggttcagcgtcctctatggttaacggcgtggtaaagctgctcaccaaaccttgggacgtgatcccaatggtcactcagcttgctatgacagataccacacccttcgggcagcagagagtgtttaaggaaaaagttgacactaggacccctcaaccaaagcccggaacgcgcatggtgatgaccacaactgcaaattggctgtgggccttactgggcaaaaagaagaacccgcgattgtgcacccgggaggagttcatcagcaaagtcagaagtaatgctgccattggtgcagtgtttcaggaagagcaggggtggacatccgccagcgaagctgtaaacgactctaggttctgggagctcgttgataaggaacgcgcgctgcaccaagagggaaaatgtgagtcatgcgtgtataacatgatgggcaagagagaaaaaaagctaggcgagtttgggcgggccaagggaagtagggcaatatggtacatgtggcttggtgctcgtttcctggaattcgaggccctcggctttctgaatgaagaccattggttcgggcgagagaactcctggagcggagtcgagggcgaaggtttgcaccgcctggggtatatcctcgaggaaattgataaaaaggacggagatcttatgtacgcagacgatactgccggctgggacaccagaatcacggaggatgacctgcagaatgaggaattaattacagagcagatggctcctcatcacaaaatcctggccaaggcgatatttaaattgacctatcagaacaaggtggtgaaggtcctccggcccactccaaggggcgcagttatggatatcatttctcgcaaagaccaaagagggtcgggacaggtgggtacatacggcctgaataccttcactaacatggaagtacagctaatccggcagatggaggccgaaggggtgattacccaagatgacatgcagaatcctaagggacttaaagagagggtcgagaagtggctgcgagaatgcggcgtggaccgtctcaaaagaatggctatctcaggtgatgactgtgttgtgaagcccctggatgagcgctttgggacaagcttgttattcctgaacgacatgggaaaagtccggaaggatataccacagtgggaaccctccaagggctggaaaaattggcaggaggtgcctttttgcagtcatcacttccacaagatttttatgaaagacggcaggtctctcgtagttccatgtagaaaccaagatgaacttatcgggcgcgcccggatcagccagggagcaggttggtccctgagggagacggcttgcctaggcaaggcctacgctcagatgtggtcactgatgtatttccatcgaagagacctccggttggccagtatggcaatttgttctgcggtgccgaccgagtggtttcccactagcaggacaacctggtccatacacgcccatcaccagtggatgactacagaagatatgctgaaagtctggaatcgcgtgtggatcgaggacaaccctaatatgattgataagaccccagttcactcatgggaagacatcccctaccttgggaagcgtgaggacctgtggtgcggaagcctcattggcttatcttccagagctacgtgggccaaaaacatccatacagcaataacccaagtgcgaaatctgatcggtaaggaagagtatgtcgattacatgagtgtgatgaaaaggtatagcgctccttcggagtccgaaggggtattgtga

SEQ ID NO: 15755 - RNA, 9867 nt, synthetic construct
  misc_feature 1..9867: note = derived and/or modified CDS sequence (opt3) from DENV-4__KC762694__SS-prME
  source 1..9867: mol_type = other RNA
agcaccatgacactgctctgccttatccccactgtgatggccttccacctgtccacgagagacggcgagcctttgatgattgtcgctaagcatgaaagagggcggccattactgtttaagaccacagagggaataaacaagtgtactctaatcgcaatggatctcggtgaaatgtgcgaggacaccgttacatacaagtgtccgctgcttgtgaataccgaacccgaggatattgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaagcatgcccaacgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtgatactcacgccgtcgggaacgacaccagcaatcacggcgtgacagcaaccataactcctcgttccccatcagtagaggttaagttaccggattacggagaactgacgctcgactgcgagccccgcagtggcattgacttcaacgagatgatccttatgaagatgaaaaagaaaacatggctggtgcataagcagtggtttttggatctacctctgccatggaccgctggggccgacactagcgaagtccactggaattacaaagagagaatggtgaccttcaaggtcccccatgcgaaaaggcaggatgtgacagttctcggatctcaggaaggtgccatgcactccgcactggctggcgccaccgaggtggactcaggggatggaaaccacatgtttgctggccatcttaagtgtaaggtacggatggaaaaactgcgaattaagggtatgagctatactatgtgcagtgggaaattctctatcgacaaggagatggccgagacacaacacggcacgaccgtcgtgaaagttaagtacgaaggagcaggcgccccttgtaaggtgccaatcgagattcgcgatgtcaataaagaaaaggtggtagggagaataatctccagcactcccttcgctgagaacacaaactcggtgaccaatattgagttggaaccgccttttggagactcttatatcgttataggtgtcggcgattccgcgctcacactgcattggttcaggaaagggtcaagtattggaaagatgtttgagagcacttaccggggcgcaaaacgcatggccatcttaggtgaaaccgcttgggacttcgggtccgtgggcggactgtttacgtctctaggcaaggccgtgcaccaggtcttcgggagcgtttataccacaatgtttggaggcgtgtcatggatgatcaggattctcatcggtttcctggtgctttggattgggactaacagtaggaatacctccatggcaatgacatgcatagccgtaggaggcatcactttgtttctgggtttcaccgtccaggctgatatgggctgtgtggttagctggaacgggaaggagctcaaatgcggatctggcatttttgtggtcgacaatgtgcatacgtggacagaacaatacaagttccagcccgagtcaccagcccgtctggcaagtgcgatccttaacgctcacaaagacggggtttgtggaatccggagcacctcccgactggagaatgtgatgtggaagcagattactaacgaattgaattatgtactctgggagggcggtcacgatctgacagtcgtggccggggacgtgaaaggagtcttaaccaagggcaagagagcactgactcctcccgttaacgatctaaaatactcttggaagacctggggtaaagccaagatatttacaccagaagctagaaattcgacgttcctcatcgacggccccgataccagcgagtgccctaacgaacgccgggcctggaatttctttgaggtggaggactacgggttcggaatgtttactacaaacatttggatgaaattcagagaaggctcctcagaggtatgtgatcataggctgatgagtgcagctatcaaggaccagaaagccgtgcacgcggatatggggtattggattgaatctagcaagaatcaaacctggcagatcgagaaggcctcccttatagaagtcaaaacatgcttgtggccaaagactcataccctgtggtcaaacggagtgctcgagagccagatgctgatcccgcgctcttacgctggccccttttcccagcacaactatcgacaaggttacgcaacgcagacagccgggccttggcacttaggaaaactggagattgacttcggcgaatgcccaggtaccactgttaccatccaggaggattgtgaccatcggggccccagtcttcgtacaactaccgctagcgggaagttggtgacacagtggtgctgtagatcttgcacgatgcctccactcaggtttctgggagaagatggctgttggtatgggatggagattcgccccctatccgagaaagaagagaatatggtcaagtcacaagtgaccgccggacagggcacaagtgaaacattcagcatgggtctgctctgcctgaccctttttgttgaggaatgtttgcggagaagggtgactcgaaagcacatgatcctggtcgtagtgataacattctgcgcaattatcttagggggactcacctggatggacctgcttcgcgcgctgattatgttgggcgacacgatgtcgggccggatcgggggacagatacatctcgccatcatggctgtttttaaaatgtccccgggttacgtgctgggcgtcttcctaagaaagctgacttctagggagaccgccctcatggtgattgggatggcaatgacaaccgtatttagcatccctcacgatctgatggagcttattgacggaatctcattgggcctgatattactcaaaattgtgactcatttcgataacacacaggtcggtaccctggctcttagtctgacattcatccgttccactacgcccctggttatggcctggcgcaccatcatggcagtgtttttcgtggtcacactcattcccctgtgtcggacctcttgcttgcaaaagcagagccactgggtggaaatcactgccctgattttaggggctcaggcgctccctgtttatctgatgacccttatgaaaggagcctccagaaggtcatggcccctgaatgagggcataatggcagtaggcttggtgagcctcctggggagtgctctactgaagaacgacgtcccacttgccggacctatggtggccggtggcctcctgttggctgcatacgttatgtctgggtccagcgccgatctgtcgttagaaaaggcggctaatgtgcaatgggacgagatggccgatatcacaggatcatctcccattatcgaagtcaaacaggacgaggatggcagtttttccattcgagacgtggaggaaactaacatgatcaccctcctggtaaaacttgcactgataacggtcagcggtttgtacccactcgccatcccggtgacaatggctctgtggtatgtttggcaagtgaaaacccagcggtctggggcactatgggatgtccctagccccgccgcgactcaaaaggctacactgtccgagggagtgtaccgcattatgcagagaggccttttcggcaaaacccaggttggggtgggaatccacatggaaggtgtctttcatactatgtggcacgtgacaaggggctcagtaatttgtcatgagaccgggcggctcgaaccaagttgggccgacgtgcgaaatgatatgatcagctatggaggcggttggagactgggggacaagtgggacaaggaggaggatgttcaggtcttggcaatagaacccggcaagaaccctaagcacgtgcaaacgaaaccaggcttattcaagactctgaccggcgagattggggccgtgacactcgactttaaacccggaacctctggttcccctatcatcaataagaaaggcaaggtcattgggctgtacggaaacggcgtagtgacaaagtcaggtgattatgttagtgctataactcaggccgaacgcatcggggagccggactacgaggtggatgaagacattttcaggaaaaagcgtcttaccatcatggatctgcatccaggagcaggcaaaacgaagcggattttgcccagcatcgtcagagaggctctaaaaaggcgcctgcgaacactcatactggcccctactagagtggttgcggccgaaatggaggaagcacttcggggcttaccaatcaggtatcagacccccgctgtgaagtccgagcacacagggcgcgagattgtcgacctgatgtgccacgccacctttactacccgtctcttgtcttcgacaagagtgcctaattacaacctgatcgtaatggatgaagctcatttcacggacccgtgcagcgtggcagcccggggatacatttcaactagggttgagatgggtgaagccgctgcgatctttatgaccgcaacacccccaggctccatagatcctttcccccagagtaattctccaattgaggacatcgaacgcgagatccctgagcgaagctggaacaccgggttcgactggattactgattatcaaggaaagacagtctggtttgtgccctccatcaaagccggcaatgacatagctaactgtctcagaaagtcaggtaaacgggtgattcagctgtctaggaagaccttcgatacggaatacccaaaaactaaacttacagactgggattttgtcgttaccaccgacatcagcgagatgggggccaacttccgcgcaggcagagtgattgatccgaggcggtgcctgaagcctgtaatcttgactgacggacccgaacgtgtgatactagccggcccaattcccgtcactcctgctagtgcggcccagcgccgagggagaatcggaaggaatccagcacaagaggatgaccagtatgtgttttccggtgatcccctgaaaaacgacgaagatcacgctcattggaccgaggccaagatgctcttagacaatatctacacacctgagggcattatcccgactctgttcgggccagaacgggagaaaacgcaggcaattgacggagaatttcgccttagaggcgagcagaggaagaccttcgttgagctgatgcggcgaggtgatctccccgtgtggttgagctataaagtcgcctctgctgggatatcatacaaggacagagaatggtgttttacaggcgagcgcaacaatcaaatcctggaagagaacatggaagtagagatttggactagggagggagaaaagaaaaagctccggcctaaatggctggatgcccgtgtgtatgcggaccccatggcacttaaggatttcaaagagtttgcctccggcagaaagagtatcaccctagacatcctgacagaaattgctaccttgccaacttacttaagctcgaaggccaaactggctctcgataatatagttatgctgcacacgaccgagaaaggtgggagggcataccagcacgcccttaacgaactgcctgagtctctcgagacattgatgctggtggctctactgggggccatgactgcaggcatcttcctctttttcatgcaggggaaaggaattggcaaactttccatgggtctgatcgcgattgccgtcgctagcgggttattgtgggtggccgaaatccagccccaatggatagcagcttcaatcattctggagttctttctcatggtcctgcttatcccagaacctgagaaacagcgcaccccgcaggacaatcagctgatttatgtgatcctcacaatattgaccattatcggcctgattgccgcaaacgaaatgggattaatcgagaagactaaaacagatttcggcttttaccaagttaagacggagaccactatactagacgtggatctgcggcccgccagtgcttggacactctatgcggtagccaccaccatccttacaccaatgctgcgacatactattgaaaatacgtctgcaaacttgtccctggctgccatcgccaatcaggcagctgtgctcatggggctgggaaagggctggcctcttcacagaatggacctcggtgtccccctgttggccatggggtgctacagccaggttaacccaaccacactgactgcgtcattagtgatgctactggtccattatgctattatcggacctggcctccaggccaaagcaaccagggaggcccaaaagcgcacagctgcaggtataatgaaaaatcccaccgtggatggcattactgtaatcgaccttgaaccgatcagttacgacccaaagttcgagaaacagctgggacaggtgatgttgctggttctctgtgtgggacaactgcttttaatgcggacgacatgggccctgtgcgaggtcctcaccttggcgactggccctgtgatgaccctgtgggaagggaaccccggaagattttggaacacaactattgctgtcagcaccgccaatatcttccgtggctcctatctagccggtgcagggctggctttttctctcataaagaacgcccagacaccaaggcggggaacgggcaccactggtgagacacttggcgaaaagtggaaacgccagctgaatagcttggatcgaaaggagttcgaagagtacaaaagatccgggattctggaggtggacaggaccgaagcaaagtcagctctccgggatggatctaaaatcaagtacgccgttagtcgcggctcgagcaagattagatggatcgtagagagggggatgataaaacccaagggaaaagtggtcgacctgggctgtggtcgagggggatggtcctattacatggcgactttaaagaacgtgacagaagttaaaggctataccaagggcgggcctggacacgaggaaccgatccccatggccacgtacggttggaatcttgtgaagctgcattctggcgtcgatgtgttttataaaccaaccgagcaggtagacacactcctatgcgatattggggagtcaagctccaaccctactatcgaagagggacggaccctgcgtgtgttgaagatggttgaaccctggctgagttctaaacctgagttctgtattaaggtcctcaatccatacatgcccacagtgatcgaagaacttgagaaactgcaaagacgccacggcggtagcttggtgaggtgccctctgtcacggaactccactcacgaaatgtattgggtcagtggggcaagcggaaatattgtttcttccgtgaacaccatctcaaagatgctcttaaatagatttacaacccgccataggaaaccaacttacgagaaggacgtagatctgggcgctggcacgcgaagcgtgtcgacagaaaccgagaagcccgacatgactataattgggcggagacttcagaggctgcgcgaggaacacaaagagacctggcattacgatcaggaaaacccgtatcgtacatgggcctaccacggatcttatgaggcacctagtacgggttccgctagctcaatggtcaatggcgtggttaagctactcaccaaaccatgggacgtgatccccatggtcactcagctggccatgacagacaccactcctttcgggcaacagcgggtgtttaaggaaaaagtagatacaagaaccccacagcccaagccgggaacaaggatgatcatgactaccacggccaactggttgtgggcgctgctcggcaagaaaaagtcccctcgcctttgtacccgagaggagttcatttctaaagttcggagcaatgctgcaataggtgccgtgttccaggaggaacaggggtggacaagtgcttccgaagccgtcaacgacagcagattttgggagctggtggataaggaaagggcattacaccaggagggaaaatgcgagtcttgcgtgtacaatatgatgggcaagcgcgaaaagaaactgggcgagttcgggagagccaagggatcacgggctatctggtatatgtggttgggtgcgaggtttctcgagttcgaggccctgggctttctaaacgaagaccattggttcagtcgtgagaactcctggagcggggtcgagggagaaggccttcaccgactgggttacattctcgaggatatcgacaaaaaggatggggacctgatttatgcagatgacactgctggatgggatacccgcatcacagaagacgatttgctgaatgaggagctcataactgaacagatggccccacatcacaaaacccttgcaaaggccatctttaagctgacgtaccaaaacaaagttgtgaaggtattaagaccaacacctaaaggcgctgtgatggacattatctctcggaaggaccagaggggctcggggcaggtcggaacctacggtctgaatactttcacaaacatggaggtgcagttgattcgccaaatggaagccgagggcgttatcacccaggatgacatgcagaatcccaaagggctcaaggaaagagtggagaaatggctgaaggagtgtggagtcgatcggctaaagaggatggcgatatcaggcgacgattgcgtggtaaaaccacttgacgaacgatttagcacttccctactcttcctgaacgatatgggtaaggttcgtaaagacattccccagtgggagcctagtaaggggtggaaaaattggcaagaagtgccattttgttctcatcacttccacaagatctttatgaaggatggaaggagcttggtcgtgccgtgccgcaaccaggacgagttaatcggccgggcaaggatttcccagggcgccgggtggtcactgagagaaaccgcttgtctcggaaaagcctatgcacagatgtggagtcttatgtacttccatcgccgggatctgaggctagcttctatggccatatgcagcgctgttcccacagagtggttccctacgtcccgaaccacttggtcaatccacgcccatcaccaatggatgacaaccgaggacatgctgaaggtgtggaatagagtctggattgaagacaacccaaatatgactgataaaacacccgtgcacagctgggaggacatcccttatctcggtaagcgggaagatttgtggtgtggctctctgattgggctttccagtagggcaacctgggcgaaaaacatccatacggccataacacaggtacgcaatctgatcggaaaggaggaatacgtggactatatgccagctatgaagcgttacagcgccccctttgagtcggagggcgtcctctga

SEQ ID NO: 15756 - RNA, 9867 nt, synthetic construct
  misc_feature 1..9867: note = derived and/or modified CDS sequence (opt3) from DENV-4__KC762695__SS-prME
  source 1..9867: mol_type = other RNA
tcgaccatgacactgctctgccttatccccactgccatggctttccacctgtccacgagagacggagagcctttgatgattgtggcaaagcatgaaagggggcggccattactgtttaaaaccacagagggaataaacaagtgtactttaatcgccatggatctcggtgaaatgtgcgaggacaccgtcacatacaaatgtccgctgcttgttaataccgaacccgaggatattgactcttggtgcaacctgacttcaacatgggtgatgtatggaacctgtacgcagagtggggagcgccgacgtgaaaagagaagcgtagcgttgactcctcactccggaatgggcctcgagaccagggctgaaacatggatgtcttcggagggtgcctggaaacatgcacaacgggtggagtcatggatcctgcgcaatccagggttcgccctgctcgctggatttatggcatacatgattggccagactggcatccagagaaccgtcttctttgtgttaatgatgctggttgcccccagctatgggatgaggtgcgtgggagtcggtaaccgggatttcgtggaaggcgtaagtgggggagcttgggttgaccttgtgttggagcacggcggttgtgtcacaaccatggcccaggggaagcctacgctggattttgaactgactaagacaaccgcgaaagaggtggcactcctgcgcacttactgcatagaagcctccatctctaatattacaaccgctacgcgatgtccaacccaaggagagccctatcttaaggaggaacaggaccagcagtacatctgcagaagggatgtggtcgaccggggctggggcaacgggtgtggactgttcggtaaaggcggggttgtgacatgcgccaagtttttgtgcagcggaaaaattactggcaatctcgtacaaatcgagaacctggaatataccgtggtcgtgacagttcataatggtgatactcacgcagtggggaacgacacctccaatcacggcgtcacagctaccataactcctcgttcaccaagtgtggaggtaaagttaccggattacggagaactgacgctcgactgtgagccccgcagcggcattgacttcaacgagatgatccttatgaagatgaaaaagaaaacatggctggttcataagcagtggtttttggatctgcctctgccatggaccgccggggcggacacttctgaagtgcactggaattacaaagagagaatggtcaccttcaaggtgccccatgccaaaaggcaggatgtcacagtgctcggatcccaggaaggtgcaatgcactcagctctggccggcgctaccgaggttgacagcgggaacggaaatcacatgtttgccggccatcttaagtgcaaggtgcggatggaaaaactgcgaattaagggtatgagttatactatgtgttctgggaaattctccatcgataaggagatggcagagacacaacacggcacgaccgtagtcaaagtgaagtacgaaggagccggcgctccttgcaaggttccaatcgagattcgcgacgtgaacaaagaaaaggtcgtggggagaataatcagctcgactcccttcgcggagaacacaaattctgtaaccaacattgagttggaaccgccttttggagattcctatatcgtgataggtgttggcgactcagcactcacactgcattggttcaggaaagggagtagcattggaaagatgtttgagtccacttaccggggcgccaaacgcatggctatcttaggtgaaaccgcctgggatttcgggtctgtcggcggactgtttacgagcctaggcaaggcaatccaccaggtgttcgggtcagtgtataccacaatgtttggaggcgtcagttggatgattagaatcctcattggtctgcttgttttgtggatagggactaattccaggaacaccagcatggccatgacatgtatcgctgtgggaggcattactctgttcctcggttttaccgtgcaggccgacatgggctgcgtagtctcttggaatgggaaggagctgaaatgtggatcaggcatcttcgtggttgataacgtgcatacgtggacagaacaatacaagtttcagcccgagagtccagcacgtcttgcgagcgctatcctgaatgcccacaaagacggggtctgcggcattcggtccaccactcgattggagaacgtgatgtggaagcagataacaaatgaactcaactatgttctgtgggagggcggtcacgacttaaccgtggtagcaggggatgtcaaaggagtgctgactaagggcaagagagccctaacccctcccgtgaatgacctcaaatactcttggaagacatggggtaaagctaagatcttcacgccagaagccaggaactcgacctttctgattgatggccccgacactagcgagtgtcctaatgaacgccgggcatggaacttccttgaggtcgaggattacgggttcggaatgttttccacaaatatctggatgaaattcagagaaggctcaagtgaggtttgcgaccataggttgatgtctgctgccattaaggatcagaaagcggtgcacgccgacatggggtattggatcgaaagctccaagaaccaaacctggcagatagagaaggcttcactgatcgaagtaaaaacatgtctctggccaaagactcataccctgtggagcaacggagtgttagagtctcagatgctgattccgcgctcctacgcaggcccctttagtcagcacaattatcgacaaggttacgccacgcagatcgctgggccttggcaccttggaaaattggagattgatttcggcgaatgcccaggtacaaccgtcactatccaggaggactgcgatcatcggggccccagcctccgtaccacaactgcctctgggaagctggtgacccagtggtgttgcagatcctgtacaatgcctccactaaggtttctgggagaagacggctgctggtatgggatggagatacgccccctctcagagaaagaagagaacatggttaagagtcaagtgacggcaggacagggcaccagcgaaactttctcgatgggtctgctttgtttgacactgtttgtcgaggaatgcttacggagaagggtgacccgaaagcacatgattctcgttgtgactatcacattctgtgcgattatcctagggggacttacctggatggatctgttgcgcgccctcataatgctgggcgacacgatgtccggccggatcgggggacagattcatctagctatcatggccgtctttaaaatgtctccgggttacgtactgggcgtgttcctcagaaagctgactagcagggagaccgcacttatggttattgggatggctatgacaaccgtgttttcaatccctcacgacttgatggagctgatagatggaattagtttaggcctcatcctgcttaaaatcgtcactcatttcgacgatacacaggtgggtaccctggccctatccctcacatttattcgttctactaccccactggtaatggcatggcgcacgatcatggccgtgttcttcgtcgttacattgattcccctgtgccggaccagctgtttacaaaagcagtcccactgggtggaaataactgctctcatcctgggggcgcaggcccttcctgtgtatctgatgaccttgatgaaaggagcatcaagaaggagctggcccctcaatgagggcattatggctgtcggcctggtgagtctactggggtctgcccttctcaagaacgacgttccactggccggacctatggtagctggtggcttgctgttagcagcctacgtgatgtccgggagctcggcggatctctcactggaaaaggctgccaatgtccaatgggacgagatggcagatatcacaggatctagtcccattatcgaagtgaaacaggacgaggatggctcctttagcatacgagacgttgaggaaactaacatgatcacccttctggtgaagttggccctcattacggtctctggtctgtacccactagctatcccggtgacaatggcactgtggtatatttggcaggtaaaaacccagcggagcggggccctttgggatgtcccttcccccgtggcgactcaaaaggctacactctcagagggagtttaccgcatcatgcagagaggcctgttcggcaaaacccaggtgggggtcggaatacacatggaaggtgtgtttcatactatgtggcacgttacaaggggcagtgtgatttgccatgagaccgggcggttggaaccaagctgggccgacgtccgaaatgatatgatctcttatggaggcggttggagattaggggacaagtgggacaaggaggaggatgtgcaggtactggcaatcgaacccggcaagaaccctaagcacgtgcaaacgaaaccaggcctcttcaagactctgaccggcgagattggggccgttacacttgactttaaacccggaacctccggttcacctataatcaataagaaaggcaaggtcattgggctgtacggaaacggcgtggtgacaaagagtggtgattatgtcagcgctatcactcaggccgaacgcattggggagccggactacgaggtagatgaagacatcttcaggaaaaagcgtttgaccataatggatctacatccaggagcaggcaaaacgaagcggatcctgccctccattgtgagagaggctctcaaaaggcgcctgcgaacacttatcttagcccctactagagttgtggcggccgaaatggaggaagcactgcggggcctcccaattaggtatcagacccccgctgtcaagtctgagcacacagggcgcgagatcgtggacttgatgtgtcacgccacctttactacccgtctgctctcgagcacaagagttcctaattacaacctgatagtgatggatgaagctcatttcacggacccgtgctcagtcgcagcccggggatacatttccactagggtggagatgggtgaagccgctgcgatctttatgaccgcaacacccccaggcagtaccgatcctttcccccagtctaatagcccaatcgaggacattgaacgcgagatccctgagcgatcctggaacactgggtttgactggataacagattatcaaggaaagaccgtatggttcgtgccctcaattaaagccggcaatgacatcgctaactgccttagaaagtctggtaaacgggttattcagctgagcaggaagacgttcgatactgaatacccaaaaacaaagttgaccgactgggattttgtcgtgaccactgacatcagtgagatgggggccaacttccgcgcaggcagagtgatagatccgaggcggtgtctaaagcctgtcattctgacagacggacccgaacgtgttatcctcgccggcccaatccccgtgacccctgcttccgcggcccagcgccgagggagaattggaaggaatccagcacaagaggatgaccagtatgtatttagcggtgatcccctaaagaacgacgaagatcacgctcattggacagaggccaagatgctgcttgacaatatctacactcctgagggcattataccgacgctgttcgggccagaacgggagaaaacccaggcaatcgacggagaatttcgcctcagaggcgagcagaggaagacattcgtggagttgatgcggcgaggtgatctgcccgtctggctctcttataaagtggcctcagctgggatttcctacaaggacagagaatggtgctttactggcgagcgcaacaatcaaatcctggaagagaacatggaagttgagatctggaccagggagggagaaaagaagaaacttcggcctaaatggctagatgcccgtgtgtatgcggaccccatggcactgaaagatttcaaagagtttgccagtggcagaaagagcattacattggacatattaaccgaaatcgctactctgccaacgtacctctcgtctaaggccaaactggctcttgataatattgtcatgctgcacaccacagagaaagggggaagggcataccagcacgccctcaacgaattgcctgagtccctggagactctaatgctggtagctctccttggtgccatgaccgcaggcatcttcctgtttttcatgcaggggaaaggaattggcaagttaagcatcggtttgatagcgatcgccgtggcttcagggctgctctgggttgccgaaattcagccccaatggatcgcagctagtattatcctggagtttttccttatggtgctgctcataccagaacctgagaaacagcgcacaccgcaggacaatcagttgatttatgtcatcctgaccattttaactatcataggcctaatcgccgcaaacgaaatgggactgattgagaagacaaaaacggatttcggcttttaccaagtgaagaccgagactacaatcctcgacgtcgatcttcggcccgcctctgcttggaccctgtatgcggtggccaccacaattttgactccaatgctgcgacatacgatcgaaaatacctccgcaaacctcagcctggctgccatagccaatcaggcagctgttcttatggggctcggaaagggctggcctctgcacagaatggacttgggtgtgcccctgttagccatggggtgttactcacaggtaaacccaacaactctaaccgcgagtctggtgatgctccttgtccattatgctattatcggacctggcctgcaggccaaagcaacaagggaggcccaaaagcgcaccgctgcaggtatcatgaaaaatcccactgttgatggcattacggtgatcgacttggaaccgataagctacgacccaaagttcgagaaacagctggggcaggtcatgctcctggtgctttgcgtaggacaattactgctcatgcggacaacctgggccttgtgtgaggtgctgactctagcgaccggccctattatgacactgtgggaagggaaccccggaagattttggaacactaccatcgctgtttccacagccaatattttccgtggctcttatctcgccggtgccgggcttgcttttagcctgatcaagaacgcccagacgccaaggcggggaaccggcactacaggtgagaccttgggcgaaaagtggaaacgccagctaaattccctcgatcgaaaggagttcgaagagtacaaaagatcagggatactggaggtggacaggactgaagcaaagtctgctttacgggatggaagtaaaatcaagcacgccgtctcgcgcggcagctccaagattagatggatcgtggagagggggatgattaaacccaagggaaaagtcgtggaccttggctgcggtcgagggggatggtcttactatatggcgacactgaagaacgttaccgaagtaaaaggctacacgaagggcgggcctggacatgaggaaccgatccccatggccacctatggttggaatctcgtgaagctacactcaggcgtcgatgtgttttacaaaccaacagagcaggttgacactctgttgtgtgatattggggagagctccagtaaccctaccatcgaagagggacggacactgcgtgtgctcaagatggtcgaaccctggctttctagcaaacctgagttctgcataaaggtgctgaatccatatatgcccactgtaattgaagagttggagaaactgcaaagacgccacggcggttcactcgtgaggtgtcctttatcccggaacagtacccatgaaatgtactgggttagcggggcatctggaaatatcgtctcctcagtgaacacaatcagcaagatgctgcttaatagatttaccactcgccacaggaaaccaacgtatgagaaggacgtggatctgggcgctggcacacgatcggtctctaccgaaactgagaagcccgacatgaccattatagggcggagactacagaggctccgcgaggaacataaagagacatggcactacgatcaggaaaacccgtaccgtacgtgggcctatcacggaagttacgaggcaccttccaccggtagcgcttcatccatggttaatggcgtggtaaagctgttgactaaaccatgggacgtgatccccatggtcacacagctggccatgaccgacactacacctttcgggcaacagcgggtgtttaaggaaaaagttgataccagaacaccacagcccaagccgggaactaggatgattatgaccacgaccgccaactggctctgggcgcttctgggcaagaaaaagtctcctcgcttatgcacacgagaggagttcatcagcaaagtgcggagtaatgctgcaattggtgccgtctttcaggaagaacaagggtggacttccgctagcgaagccgtgaacgactctagattctgggagctggtagataaggaaagggcattgcatcaggagggaaaatgtgagtcatgcgtttataatatgatgggcaagcgcgaaaagaaactcggcgagttcgggagagccaagggaagtcgggctatctggtacatgtggctgggtgcgaggtttctagagttcgaggcccttggctttctgaacgaagaccactggttctcccgtgagaacagctggtctggggtggagggagaaggcctccatcgactgggttatatattggaggatatcgacaaaaaggatggggacctgatttacgcagatgacaccgctggatgggatacacgcatcactgaagacgatctccttaatgaggagctgattaccgaacagatggcaccccaccataaaacgttagcaaaggccatctttaagctgacatatcaaaacaaagtcgtgaaggtgttgagaccaacccctaaaggcgctgtcatggacataatttcgcggaaggaccagaggggctcagggcaggttggaacttacggtctcaatacattcaccaacatggaggtgcagctgatccgccaaatggaagccgagggcgtaatcactcaggatgacatgcagaatcccaaagggctagaagagagagtggagaagtggcttaaagaatgcggagtcgatcggctgaagaggatggcgattagcggcgacgattgtgtggttaagccactcgacgagcgattttccaccagtctgttgttcttaaacgatatgggtaaagtgcgtaaggacataccccagtgggaaccttctaaagggtggaagaattggcaagaggtcccattttgcagccaccacttccataaaatctttatgaaggatggaagatccctggtggtaccgtgtcgcaaccaggacgaactcattggccgggcaaggatctcacagggcgccgggtggagtcttagagagacagcttgcctgggaaaggcctacgcacagatgtggtctctaatgtatttccaccgccgggatctgaggctcgctagcatggccatttgttccgctgttcccacggagtggtttcctatctcacgaaccacttggagcatacatgcccaccaccaatggatgacaaccgaagacatgttgaaagtgtggaatagagtctggatcgaggacaacccaaatatgactgataagacacccattcattcttgggaagacatcccttacctgggtaaacgggaggatctttggtgcggctccctgattgggctcagtagcagggcaacctgggcgaagaacatccacacggccattagccaggtgcgcaatttaataggaaaagaagagtatgttgactacatgccagtgatgaagcgttattccgctccctctgagtcagaaggcgtcctgtga

SEQ ID NO: 15757 - RNA, 9867 nt, synthetic construct
  misc_feature 1..9867: note = derived and/or modified CDS sequence (opt3) from DENV-4__KC762696__SS-prME
  source 1..9867: mol_type = other RNA
agcaccatgacactgctctgccttatccccactgtgatggccttccacctgtccacgagagacggagagcctttgatgattgtcgctaagcatgaaagggggcggccattactgtttaagaccaccgagggaataaacaagtgtactctaatcgcaatggatctcggtgaaatgtgcgaggacaccgttacatacaaatgtccgctgcttgtgaataccgaacccgaggatattgactgctggtgtaacctgacttctacatgggtgatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtgatactcacgccgtcgggaacgacaccagcaatcacggcgtgacagcaaccataactcctcgttccccatcagtagaggttaagttaccggattacggagaactgacgctcgactgcgagccccgcagtggcattgacttcaacgagatgatccttatgaagatgaaaaagaaaacatggctggtgcataagcagtggtttttggatctacctctgccatggaccgctggggccgacactagcgaagtccactggaattacaaagagagaatggtgaccttcaaggtcccccatgcgaaaaggcaggatgtgacagttctcggatctcaggaaggtgccatgcactccgcactggctggcgccaccgaggtggactcaggggatggaaaccacatgtttgctggccatcttaagtgtaaggtacggatggaaaaactgcgaattaagggtatgagctatactatgtgcagtgggaaattctctatcgacaaggagatggccgagacacaacacggcacgaccgtcgtgaaagttaagtacgaaggagcaggcgccccttgtaaggtgccaatcgagattcgcgatgtcaataaagaaaaggtggtagggagaataatctccagcactcccttcgctgagaacacaaactcggtgaccaatattgagttggaaccgccttttggagactcttatatcgttataggtgtcggcgattccgcgctcacactgcattggttcaggaaagggtcaagtattggaaagatgtttgagagcacttaccggggcgcaaaacgcatggccatcttaggtgaaaccgcttgggacttcgggtccgtgggcggactgtttacgtctctaggcaaggccgtgcaccaggtcttcgggagcgtttataccacaatgtttggaggcgtgtcatggatgatcaggattctcatcggtttcctggtgctttggattgggactaacagtaggaatacctccatggcaatgacatgcatagccgtaggaggcatcactttgtttctgggtttcaccgtccaggctgatatgggctgtgtggttagctggaacgggaaggagctcaaatgcggatctggcatttttgtggtcgacaatgtgcatacgtggacagaacaatacaagttccagcccgagtcaccagcccgtctggcaagtgcgatccttaacgctcacaaagacggggtttgtggaatccggagcaccactcgactggagaatgtgatgtggaagcagattacaaacgaattgaattatgtactctgggagggcggtcacgatctgaccgtcgtggccggggacgtgaaaggagtcttaactaagggcaagagagcactgacccctcccgttaacgatctaaaatactcctggaagacatggggtaaagccaagatatttacgccagaagctagaaattctaccttcctcatcgacggccccgatacttcggagtgccctaacgaacgccgggcctggaatttctttgaggtggaggactacgggttcggaatgtttacaaccaacatttggatgaaattcagagaaggcagctccgaggtatgtgatcataggctgatgtcagcagctatcaaggaccagaaagccgtgcacgcggatatggggtattggattgaaagttctaagaatcaaacatggcagatcgagaaggccagccttatagaagtcaaaacttgcttgtggccaaagacccatacgctgtggtccaacggagtgctcgagtcacagatgctgatcccgcgcagctacgctggccccttttctcagcacaactatcgacaaggttacgcaacacagaccgccgggccttggcacttaggaaaactggagattgacttcggcgaatgcccaggtactaccgttacaatccaggaggattgtgaccatcggggcccctcccttcgtactaccacagctagtgggaagttggtgacgcagtggtgctgtagaagctgcaccatgcctccactcaggtttctgggagaagatggctgttggtatgggatggagattcgccccctatctgagaaagaagagaatatggtcaagtcccaagtgactgccggacagggcacatcagaaaccttcagtatgggtctgctctgcctgactctttttgttgaggaatgtttgcggagaagggtgacacgaaagcacatgatcctggtcgtagtgataaccttctgcgcaattatcttagggggactcacgtggatggacctgcttcgcgcgctgattatgttgggcgacactatgagcggccggatcgggggacagatacatctcgccatcatggctgtttttaaaatgtcgccgggttacgtgctgggcgtcttcctaagaaagctgacctccagggagacagccctcatggtgattgggatggcaatgaccactgtattttctatccctcacgatctgatggagcttattgacggaatcagcttgggcctgataattttaaaaatcgtgacacatttcgataacacccaggtcggtacactcgctctgtcacttactttcatccgtagtaccacgccactggttatggcctggcgcacaattatggcagtgtttttcgtggtcaccctaatccccctctgtcggacttcctgcctgcaaaagcagtctcactgggtggaaattaccgccttgatactgggggctcaggcgttacctgtttatctcatgacactgatgaaaggagccagcagaaggtcctggccccttaatgagggcatcatggcagtaggcctggtgtcattgctcgggagcgctctgctaaagaacgacgtcccactggccggacctatggtggccggtggccttctcctggctgcatacgttatgagtgggtcttccgccgatttgagcctggaaaaggcggctaatgtgcaatgggacgagatggccgatattactggatcgtcacccatcattgaagtcaaacaggacgaggatggctcttttagtatccgagacgtggaggaaaccaacatgataacgttactcgtaaagctggcacttatcacagtctccggtctgtacccattggccattccggtgaccatggctctctggtatgtttggcaagtgaaaactcagcggagcggggcactgtgggatgtcccttctcccgccgcgacacaaaaggctaccctaagcgagggagtgtaccgcatcatgcagagaggcctgttcggcaaaactcaggttggggtgggcattcacatggaaggtgtctttcatacaatgtggcacgtgaccaggggctccgtaatctgtcatgagacggggcggcttgaaccatcatgggccgacgtgcgaaatgatatgataagttatggaggcggttggagactcggggacaagtgggacaaggaggaggatgttcaggtcctggcaattgaacccggcaagaaccctaagcacgtgcaaactaaaccaggcttgttcaagaccttaacaggcgagatcggggccgtgaccctggactttaaacccggaacaagcggttctcctatcattaataagaaaggcaaggtcatagggctctacggaaacggcgtagtgactaagtccggtgattatgtttcagctatcacccaggccgaacgcattggggagccggactacgaggtggatgaagacatcttcaggaaaaagcgtctgacgattatggatcttcatccaggagcaggcaaaacaaagcggatcctgcccagtatagtcagagaggctttgaaaaggcgcctacgaactctgatcctcgcccctaccagagtggttgcggccgaaatggaggaagcactgcggggccttccaattaggtatcagacacccgctgtaaagagcgagcacaccgggcgcgagatcgtcgacttaatgtgccacgccacttttaccacacgtctgctctcctctacgagagtgcctaattacaacttgattgtaatggatgaagctcatttcactgacccgtgctcggtggcagcccggggatacatcagcaccagggttgagatgggtgaagccgctgcgatatttatgacagcaacacccccaggctcaattgatcctttcccccagtccaatagtccaatcgaggacatcgaacgcgagattcctgagcgatcttggaacactgggttcgactggatcacagattatcaaggaaagaccgtctggtttgtgcccagcataaaagccggcaatgacattgctaactgtctgagaaagtccggtaaacgggtgatccagctctcaaggaagacgttcgatactgaatacccaaaaacaaagctgaccgactgggattttgtcgttaccactgacatttctgagatgggggccaacttccgcgcaggcagagtgatcgatccgaggcggtgccttaagcctgtaatactgacagacggacccgaacgtgtgattttggccggcccaatccccgtcacccctgctagcgcggcccagcgccgagggagaatcggaaggaatccagcacaagaggatgaccagtatgtgtttagtggtgatcccttaaagaacgacgaagatcacgctcattggacagaggccaagatgctgctcgacaatatttacactcctgagggcatcattccgacgttattcgggccagaacgggagaaaacccaggcaatagacggagaatttcgcctgagaggcgagcagaggaagacattcgttgagcttatgcggcgaggtgatctgcccgtgtggctctcctataaagtcgccagcgctgggatctcttacaaggacagagaatggtgttttactggcgagcgcaacaatcaaattttggaagagaacatggaagtagagatctggaccagggagggagaaaagaaaaagctgcggcctaaatggctcgatgcccgtgtgtatgcggaccccatggcactgaaggatttcaaagagtttgcctcaggcagaaagtccatcacacttgacattctaaccgaaatagctactctgccaacgtacttgagtagcaaggccaaattagctctggataatatcgttatgctccacaccacagagaaaggtgggagggcataccagcacgccctgaacgaacttcctgagtcgctggagactctcatgttggtggctctgctaggggccatgaccgcaggcattttcctgtttttcatgcaggggaaaggaatcggcaagctctctatgggtcttattgcgatcgccgtcgcttccgggctgttatgggtggccgaaatacagccccaatggatcgcagctagcattatcttggagttctttctgatggtcctcctgattccagaacctgagaaacagcgcacaccgcaggacaatcagcttatctatgtgatactgaccattctcactatcattggcttgatcgccgcaaacgaaatgggactgatagagaagacaaaaacggatttcggcttttaccaagttaagaccgagactacaatcttagacgtggatctacggcccgcctcagcttggaccctgtatgcggtagccaccacaattctcactccaatgcttcgacatacgatcgaaaataccagtgcaaacctgtctttggctgccattgccaatcaggcagctgtgctgatggggctcggaaagggctggcctctgcacagaatggaccttggtgtccccctcctggccatggggtgctactcccaggttaacccaacaactttgaccgcgagcctggtgatgctgctagtccattatgctatcataggacctggcctacaggccaaagcaacaagggaggcccaaaagcgcaccgctgcaggtattatgaaaaatcccactgtggatggcatcacggtaatcgacctcgaaccgatttcatacgacccaaagttcgagaaacagcttggacaggtgatgctgttggttctgtgtgtgggacaactcctgcttatgcggacaacctgggccttatgcgaggtcctgactctcgcgaccggccctgtgatgacattgtgggaagggaaccccggaagattttggaacactaccatcgctgtcagtacagccaatatattccgtggcagctatctggccggtgccgggctagctttttccctgattaagaacgcccagacgccaaggcggggaaccggcactacaggtgagaccctcggcgaaaagtggaaacgccagcttaattctctggatcgaaaggagttcgaagagtacaaaagaagcgggatcttggaggtggacaggactgaagcaaagtccgctctgcgggatggatcaaaaattaagtacgccgtttctcgcggcagttcgaagatcagatggatagtagagagggggatgatcaaacccaagggaaaagtggtcgacctcggctgtggtcgagggggatggagctattacatggcgacactgaagaacgtgaccgaagttaaaggctatacgaagggcgggcctggacacgaggaaccgattcccatggccacctacggttggaatttagtgaaacttcattccggcgtcgatgtgttttataaaccaacagagcaggtagacactctgctctgcgatatcggggagtcttcaagcaaccctaccattgaagagggacggacactacgtgtgctgaagatggttgaaccctggttgtccagtaaacctgagttctgtatcaaggtcctgaatccatacatgcccactgtgattgaagaactcgagaaacttcaaagacgccacggcggttctctggtgaggtgccctttgagccggaactcaacccacgaaatgtattgggtctccggggcaagtggaaatatcgttagctctgtgaacacaatatccaagatgctgctcaatagatttaccactcgccataggaaaccaacgtacgagaaggacgtagatttaggcgctggcacacgatcagtgagcaccgaaactgagaagcccgacatgaccattatcgggcggagactgcagaggcttcgcgaggaacacaaagagacatggcattacgatcaggaaaacccgtatcgtacgtgggcctaccacggatcgtatgaggcaccttctaccggtagtgcttccagcatggtcaatggcgtggttaagctgctaactaaaccatgggacgtgatccccatggtcacacagctcgccatgaccgacactacacctttcgggcaacagcgggtgtttaaggaaaaagtagataccagaacaccacagcccaagccgggaactaggatgattatgaccacgaccgccaactggctgtgggcgttgctgggcaagaaaaagtcacctcgcctctgtacacgagaggagttcatatccaaagttcggtctaatgctgcaatcggtgccgtgttccaggaggaacaggggtggactagcgctagtgaagccgtcaacgactccagattttgggagcttgtggataaggaaagggcactgcaccaggagggaaaatgcgagagctgcgtgtacaatatgatgggcaagcgcgaaaagaaattaggcgagttcgggagagccaagggatctcgggctatttggtatatgtggctgggtgcgaggtttttggagttcgaggccctcggctttctgaacgaagaccattggttctcacgtgagaacagttggtccggggtcgagggagaaggcctacaccgacttggttacatcctggaggatattgacaaaaaggatggggacctcatctatgcagatgacaccgctggatgggatacacgcataactgaagacgatctgttgaatgaggagctgatcaccgaacagatggcaccccatcacaaaacgctcgcaaaggccatttttaaacttacataccaaaacaaagttgtgaaggtactgagaccaacccctaaaggcgctgtgatggacatcattagccggaaggaccagaggggctctgggcaggtcggaacttacggtttaaatacattcaccaacatggaggtgcagctgatccgccaaatggaagccgagggcgttataactcaggatgacatgcagaatcccaaagggttgaaggaaagagtggagaaatggctcaaggagtgtggagtcgatcggctgaagaggatggcgatttcgggcgacgattgcgtggtaaaaccactagacgaacgattttcaaccagccttctgttcctcaacgatatgggtaaggttcgtaaagacatcccccagtgggagccttccaaggggtggaaaaattggcaagaagtgccattttgtagtcatcacttccacaagatctttatgaaggatggaagatctctggtcgtgccgtgccgcaaccccgacgagttgattggccgggcaaggataagccagggcgccgggtggtccttaagagaaacagcttgtctgggaaaagcctatgcacagatgtggtcactcatgtacttccatcgccgggatcttaggctggctagtatggccatctgctctgctgttcctacggagtggttcccaaccagccgaactacatggtccattcacgcccatcaccagtggatgaccactgaggacatgctaaaggtgtggaatagagtctggatcgaagacaaccccaatatgacagataaaacccctgtgcactcatgggaggacattccatatctgggtaagcgggaagatctctggtgtggcagcttgatcgggctgtcttccagggcaacgtgggcgaaaaacatacatacagccatcacccaagtacgcaatcttattggaaaggaggaatacgtggactatatgcccgctatgaagcgttacagtgccccttttgagagcgagggcgtcctgtga

SEQ ID NO: 15758 - RNA, 9867 nt, synthetic construct
  misc_feature 1..9867: note = derived and/or modified CDS sequence (opt3) from DENV-4__KC762697__SS-prME
  source 1..9867: mol_type = other RNA
agcaccatgaccctgctctgccttatccccactgccatggctttccacctgtccacgcgggacggcgagcctttgatgattgtggcaaagcatgaaagggggcggccattactgtttaaaaccacagagggaataaacaagtgtactctaatcgccatggatctcggtgaaatgtgcgaggacaccgtcacatacaaatgtccgctgcttgttaataccgaacccgaggatattgactgctggtgtaacctgacttctacatgggtgatgtatggaacctgcacgcagtcaggggagcgccgacgtgaaaagagaagtgtagcgttgactcctcacagcggaatgggcctcgagaccagggctgaaacatggatgtcctctgagggtgcctggaaacatgcacaacgggtggagtcgtggatcctgcgcaatccagggttcgccctgctcgctggatttatggcatacatgattggccagactggcatccagagaaccgtcttctttgtgttaatgatgctggttgccccctcatatgggatgaggtgtgtgggagtcggtaaccgggatttcgtggaaggcgtaagcgggggagcttgggttgaccttgtgttggagcacggcggttgcgtcacaaccatggcccaggggaagcctacgctggattttgaactaactaagacaaccgcgaaagaggtggcactcctgcgcacttactgtatagaagccagtatctccaatattacaaccgctacgcgatgcccaacccaaggagagccctatcttaaggaggaacaggaccagcagtacatctgtagaagggatgtggtcgaccggggctggggcaacgggtgcggactgttcggtaaaggcggggttgtgacatgcgccaagtttttgtgttctggaaaaattactggcaatctcgtacaaatcgagaacctggaatataccgtggtcgtgacagttcataatggtgatactcacgcagtggggaacgacaccagcaatcacggcgtcacagctaccataactcctcgttccccatcagtggaggtaaagttaccggattacggagaactgacgctcgactgcgagccccgcagtggcattgacttcaacgagatgatccttatgaagatgaaaaagaaaacatggctggttcataagcagtggtttttggatctacctctgccatggaccgccggggcggacactagcgaagtgcactggaattacaaagagagaatggtcaccttcaaggtgccccatgccaaaaggcaggatgtcacagtgctcggatctcaggaaggtgcaatgcactccgctctggccggcgctaccgaggttgactcaggggatggaaaccacatgtttgccggccatcttaagtgtaaggtgcggatggaaaaactgcgaattaagggtatgagctatactatgtgcagtgggaaattctctatcgacaaggagatggcagagacacaacacggcacgaccgtagtcaaagtgaagtacgaaggagccggcgctccttgtaaggttccaatcgagattcgcgatgtgaataaagaaaaggtcgtggggagaataatctccagcactcccttcgcggagaacacaaactcggtaaccaatattgagttggaaccgccttttggagactcttatatcgtgataggtgttggcgattccgcactcacactgcattggttcaggaaagggtcaagtattggaaagatgtttgagagcacttaccggggcgccaaacgcatggctatcttaggtgaaaccgcctgggacttcgggtccgtcggcggactgtttacgtctctaggcaaggcagtgcaccaggtgttcgggagcgtctataccacaatgtttggaggcgtttcatggatgatcaggattctcatcggtctgcttgtgttgtggattgggactaacagtaggaatacctccatggccatgacatgcatagctgtgggaggcatcactctgttcctcggttttaccgtacaggccgatatgggctgtgtcgtgagctggaacgggaaggagctgaaatgcggatctggcattttcgttgtggacaatgtccatacgtggacagaacaatacaagtttcagcccgagtcaccagcacgtcttgcgagtgctatcctgaacgcccacaaagacggggtgtgtggaatccggagcaccactcgattggagaatgttatgtggaagcagattacaaacgaactcaattatgtgctgtgggagggcggtcacgatttaaccgtagtcgcaggggacgtgaaaggagtgctgactaagggcaagagagtcctaacccctcccgttaacgatctcaaatactcctggaagacatggggtaaagccaagatattcacgccagaagctagaaattctacctttctgatcgacggccccgatacttcggagtgccctaacgaacgccgggcctggaatttcttcgaggtggaggactacgggtttggaatgttcagcacaaacatttggatgaaatttagagaaggctcctcagaggtatgtgatcataggcttatgagtgcagctatcaaggaccagaaagccgtgcacgcggatatggggtattggattgaatctagcaagaatcaaacctggcagatcgagaaggcctccttgatagaagtcaaaacatgcctgtggccaaagactcataccctctggtcaaacggagtgctggagagccagatgttaatcccgcgctcttacgctggccccttctcccagcacaactatcgacaaggttacgcaacgcagattgccgggccttggcacctgggaaaacttgagatcgactttggcgaatgcccaggtacaaccgttactattcaggaggattgtgaccatcggggccccagtttgcgtaccacaactgctagcgggaagctcgtgacccagtggtgctgtagatcttgcacaatgcctccactgaggttcctaggagaagatggctgttggtatgggatggagatccgccccctgtccgagaaagaagagaatatggtcaagtcacaagtgacggccggacagggcaccagtgaaacttttagcatgggtctcctgtgccttacattgttcgttgaggaatgtctgcggagaagggtgacccgaaagcacatgatattagtcgtagcaattactttttgcgcgatcattctcgggggactgacatggatggaccttctgcgcgccttgatcatgctcggcgacaccatgtcgggccggatagggggacagatccatctggctattatggccgtgttcaaaatgtccccgggttacgttctaggcgtgtttctgagaaagctcacgtctagggagactgcactgatggtcatcgggatggctatgaccacagtgttcagcattcctcacgatcttatggagttgatcgacggaatatcactgggcttaattctcctgaaaatcgtaacccattttgatgacactcaggtgggtacacttgccctgagtctaaccttcatccgttccacaactccactcgtcatggcatggcgcaccattatggccgttttctttatggtgacgctgatccccttgtgtcggacatcttgcctgcaaaagcagagccactgggtggaaattaccgctttaatactcggggcgcaggccctgcctgtctatcttatgactctgatgaaaggagcatccagaaggtcatggcccttgaacgagggcatcatggctgtgggcctcgttagcctgctagggagtgccctgcttaagaatgatgtaccactcgccggacctatggtggctggtggcctgttgctggcagcctacgtcatgtctgggtccagcgcggacttatcgctcgaaaaggctgccaacgtgcaatgggatgagatggcagacattaccggatcatctcccatcattgaagttaaacaggatgaggacggcagtttctccatccgagatgtggaggaaacaaatatgataactctgcttgtcaagctggccttgatcaccgtgagcggtctctacccactggctattccggtaacgatggcactatggtatatctggcaggtcaaaacacagcggtctggggccctgtgggacgtgcctagccccgcggctacccaaaaggccactctttccgagggagtttaccgcattatgcagagaggcctctttggcaaaacacaggtgggggtcggaatccacatggaaggtgtgttccataccatgtggcacgttactaggggctcagtgatatgtcatgagacagggcggctggaaccaagttgggcagatgtccgaaacgacatgattagctatggaggcggttggagattgggggacaagtgggataaggaggaggacgtgcaggtattagccatcgaacccggcaagaatcctaagcacgtgcaaaccaaaccaggcctgtttaagacgctcactggcgagatcggggctgttaccctggatttcaaacccggaacatctggttcccctattataaacaagaaaggcaaggtcatcgggctttacggaaatggcgtggtgaccaagtcaggtgactatgtcagtgccattacacaggcagaacgcatcggggagccggattacgaggtagacgaagatatttttaggaaaaagcgtctgactatcatggacttgcatccaggagctggcaaaaccaagcggatactacccagcatcgtgagagaggccctgaaaaggcgcctccgaacgctgattcttgcgcctacaagagttgtggccgcagaaatggaggaggctttacggggcctgccaatcaggtatcagactcccgccgtcaaggctgagcacaccgggcgcgagattgtggatctcatgtgccacgcaacattcaccactcgtttgctgtcctctaccagagttcctaactacaatctcatcgtgatggacgaagcccattttacagatccgtgctcggtcgccgctcggggatacataagcacgagggtggagatgggtgaagcggcagccattttcatgactgctacacccccaggctcaacagacccttttccccagtccaacagtccaatcgaggacatcgaacgcgagattcctgagcgatcttggaataccgggttcgattggatcactgactatcaaggaaagacagtatggttcgtgcccagcataaaagccggcaacgatattgcaaattgtctgagaaagtccggtaaacgggttatccagctttcaaggaagacctttgacacggaatacccaaaaactaagctgacagattgggacttcgtcgtgaccaccgatatttctgagatgggggccaactttcgcgctggcagagtgatcgacccgaggcggtgcttgaagcctgtcatactaactgatggacccgaacgtgttattctggcgggcccaatccccgtgacccctgccagcgcagctcagcgccgagggagaatcggaaggaacccagcccaagaggacgatcagtatgtattcagtggtgaccccctcaaaaatgatgaagaccacgcacattggacagaggccaagatgttactggacaacatttacacacctgagggcatcattccgactctttttgggccagaacgggagaaaacgcaggctatagatggagagttccgcctgagaggcgagcagaggaagacctttgtggagctcatgcggcgaggtgacttgcccgtctggctgtcctataaagtggccagcgcggggatctcttacaaggatagagaatggtgtttcacaggcgagcgcaataaccaaattctcgaagagaatatggaagttgagatctggactagggagggagaaaagaaaaagctgcggcctaaatggcttgacgcacgtgtgtatgccgatcccatggctctaaaggactttaaagagttcgcctcaggcagaaagtccatcaccctggatattttgacagaaatagctaccttaccaacttacctgagtagcaaggcaaaactcgccctggacaacatcgtcatgcttcacacgaccgagaaaggtgggagggcttaccagcacgccctgaatgaactccctgagtcgttggagacactgatgctagtagcactgctcggggcgatgactgccggcatttttcttttctttatgcaggggaaaggaatcggcaagctgtctatgggtttaattgctatcgccgtggcatccgggttgctgtgggttgctgaaatacagccccaatggatcgccgcaagcattatcctcgagttcttcctgatggtgcttctgattccagaacctgagaaacagcgcaccccgcaggataaccagctcatctatgtcatattgacaattctgaccatcattggcttaatcgccgctaatgaaatgggactaatagagaagactaaaacagactttggcttctaccaagcgaagacggagaccactatcctggatgtggacctccggcccgcctcagcatggacactttatgctgtcgccaccaccattctgacaccaatgttgcgacatactatcgaaaacacgagtgccaatctgtctctcgcagctattgccaaccaggcggctgtgctgatggggcttggaaagggctggcctctccacagaatggatctgggtgttcccttgctggccatggggtgctactcccaggtgaatccaaccacattaactgcaagcctagtaatgctgctcgtgcattatgccatcataggacctggccttcaggctaaagcaaccagggaggcccaaaagcgcacagcggctggtattatgaaaaaccccaccgtcgacggcatcactgttatcgacctggaaccgatttcatacgatccaaagtttgagaaacagttgggacaggtgatgctgctcgtcctgtgtgtgggacaacttttactgatgcggacgacatgggccctctgcgaggtattgaccctggcaactggccctatcatgaccctatgggaagggaatcccggaagattctggaacacaactatagccgtgagtaccgctaacatttttcgtggcagctatctggccggtgcagggctcgctttctcccttatcaagaatgcccagacaccaaggcggggaacgggcaccactggtgagacactgggcgaaaagtggaaacgccagttgaactctctggaccgaaaggagtttgaagagtacaaaagaagcgggattctcgaggttgataggaccgaagcgaagtccgccctgcgggacggatcaaaaatcaagtacgcagtgtctcgcggcagttcgaagataagatggatcgtcgagagggggatggtgaaacccaagggaaaagtcgtggatttaggctgtggtcgagggggatggagctattacatggctactcttaagaatgttacagaagtaaaaggctataccaagggcgggcctggacacgaggaaccgattcccatggccacgtacggttggaacctggtgaagctccattccggcgtcgacgtgttctataaaccaaccgagcaggttgatacactactgtgcgacatcggggagtcttcaagcaatcctactattgaagagggacggaccttgcgtgtgctgaagatggtcgaaccctggctctccagtaaacctgagttttgtatcaaggtgcttaacccatacatgcccacagtaattgaagaactggagaaattgcaaagacgccacggcggttctctggtgaggtgccctctcagcagaaattcaactcacgaaatgtattgggtttccggggcaagtggaaacatcgtcagctctgtgaataccatatccaagatgttactgaacagattcacaacccgccataggaaaccaacttacgagaaggatgtggaccttggcgctggcacgcgatcagtcagcacagaaaccgagaagcccgatatgactattatcgggcggagactgcagaggctacgcgaggaacacaaagagacctggcattacgaccaggaaaatccgtatcgtacatgggcctaccacggatcgtatgaggccccttctacgggtagtgcgtccagcatggttaacggcgtggtaaagctcctgaccaaaccatgggacgtgatccccatggtcactcagttggctatgacagataccactccttttgggcaacagcgggtgttcaaggaaaaagttgacacaagaaccccacagcccaagccgggaacaaggatgattatgactaccacggcaaattggctgtgggccctccttggcaagaaaaagtcacctcgcctgtgtacccgagaggagtttatatccaaagtgcggtctaacgctgccatcggtgcagtcttccaggaagaacaagggtggacaagcgccagtgaagctgtgaatgattccagattctgggagttagtagacaaggaaagggcgctgcaccaggagggaaaatgcgagagctgcgtttacaacatgatgggcaagcgcgaaaagaaattgggcgagtttgggagagccaagggatctcgggcaatttggtatatgtggctcggtgctaggttcctggaatttgaggccctaggcttccttaatgaagatcattggttttcacgtgagaacagttggtccggggtggagggagaaggcctgcaccgactcggttacatcctggaggacattgataaaaaggacggggatttgatctatgcagacgatactgccggatgggacacccgcataacagaagatgacctgctcaacgaggagcttatcactgaacagatggctccccatcacaaaaccctggccaaggcgattttcaagttaacgtaccaaaataaagtcgtgaaggtgctgagaccaacacctaaaggcgcagtcatggacatcattagccggaaggatcagaggggctctgggcaggttggaacctacggtttgaacacttttacaaatatggaggtgcagctcatccgccaaatggaagccgagggcgtaataacccaggacgatatgcagaaccccaaagggctggaagagagagtggagaagtggctaaaagaatgtggagtcgaccggcttaagaggatggctatttcgggcgatgactgcgtggttaagccactggatgagcgattctcaactagcctcctgtttttgaatgacatgggtaaagtgcgtaaggatatcccccagtgggaaccttccaaagggtggaagaactggcaagaggtcccattctgtagtcatcactttcacaaaatcttcatgaaggacggaagatctttagtggtaccgtgccgcaatcaggatgaactgattggccgggccaggataagccagggcgcagggtggtccctcagagagaccgcttgtcttggaaaggcctatgctcagatgtggtcactgatgtactttcatcgccgggacctaaggctggccagtatggcaatctgctctgcggttcccacagagtggttccctacgagccgaaccacttggtccattcacgcccatcaccaatggatgacaaccgaagacatgctcaaagtgtggaacagagtctggatcgaggataatccaaacatgactgacaagacacccattcactcatgggaagatatcccttatttgggtaaacgggaggacctgtggtgtggcagccttatagggctgtcttccagggctacctgggccaagaatatccatacggcaattacacaggtgcgcaacctcatcggaaaagaagagtacgttgattatatgccagtgatgaagcgttacagtgctcccagcgagtcggaaggcgtcttatga

SEQ ID NO: 15759 - RNA, 9867 nt, synthetic construct
  misc_feature 1..9867: note = derived and/or modified CDS sequence (opt3) from DENV-4__KC762698__SS-prME
  source 1..9867: mol_type = other RNA
agcaccatgaccctgctctgccttatccccactgtgatggccttccacctgtccacgagggacggcgaacctttgatgattgtcgctaagcatgaaagggggcggccattactgtttaaaaccacagagggaataaacaagtgtactctgatcgctatggatctcggtgaaatgtgcgaggacaccgttacatacaaatgtccgctgcttgtgaataccgaacccgaggatattgtgtgctggtgtaacctgacttctacatgggtgatgtatggaacctgcacgcagtcaggggagcgccgacgtgaaaagagaagtgtcgccttgactcctcacagcggaatgggcctcgagaccagggcggaaacatggatgtcctctgagggtgcttggaaacatgcccaacgggtggagtcgtggatcctgcgcaatccagggttcgcactgctcgccggatttatggcttacatgattggccagactggcatccagagaaccgttttctttgtgttaatgatgctggtcgcaccctcatatgggatgaggtgtgtgggagtaggtaaccgggacttcgttgaaggcgtgagcgggggagcctgggtcgatcttgtgttggagcacggcggttgcgtgacaaccatggctcaggggaagcctacgctggactttgaactaactaagacaaccgccaaagaggtcgcgctcctgcgcacttactgtatagaagcaagtatctccaatattacaaccgccacgcgatgcccaacccaaggagagccctatcttaaggaggaacaggatcagcagtacatctgtagaagggacgttgtggatcggggctggggcaacgggtgcggactgttcggtaaaggcggggtagtgacatgcgctaagtttttgtgttctggaaaaattactggcaatctcgtccaaatcgagaacctggaatataccgtggttgtgacagtccataatggtgacactcacgccgtggggaacgataccagcaatcacggcgtaacagcaaccataactcctcgttccccatcagttgaggtgaagttaccggactacggagaactgacgctcgattgcgagccccgcagtggcattgacttcaacgagatgatccttatgaagatgaaaaagaaaacatggctggtccataagcagtggtttttggacctacctctgccatggaccgctggggccgatactagcgaagtgcactggaattacaaagagagaatggtcaccttcaaggtgccccatgcgaaaaggcaggacgttacagtgctcggatctcaggaaggtgccatgcactccgcactggctggcgccaccgaggtagattcaggggacggaaaccacatgtttgctggccatcttaagtgtaaggtccggatggaaaaactgcgaattaagggtatgagctatactatgtgcagtgggaaattctctatcgataaggagatggccgagacacaacacggcacgaccgtggttaaagtgaagtacgaaggagcaggcgccccttgtaaggtcccaatcgagattcgcgacgtgaataaagaaaaggtagtggggagaataatctccagcactcccttcgctgagaacacaaactcggttaccaatattgagttggaaccgccttttggagattcttatatcgtcataggtgcgggcgactccgcactcacactgcattggttcaggaaagggtcaagtattggaaagatgtttgagagcacttaccggggcgccaaacgcatggctatcttaggtgaaaccgcctgggatttcgggtccgtgggcggactgtttacgtctctaggcaaggcagtgcaccaggtcttcgggagcgtttataccacaatgtttggaggcgtgtcatggatgatcaggattctcatcggtttcctggtgctttggattgggactaacagtaggaatacctccatggccatgacatgcatagctgtaggaggcatcactttgtttctgggtttcaccgtccaggccgacatgggctgtgtggttagctggaacgggaaggagctcaaatgcggatctggcatttttgtggtcgataatgtgcatacgtggacagaacaatacaagttccagcccgagtcaccagcacgtctggcgagtgctatccttaacgcccacaaagacggggtttgtggaatccggagcaccactcgactggagaatgtgatgtggaagcagattacaaacgaattgaattatgtactctgggagggcggtcacgacctgaccgtcgtggcaggggatgtgaaaggagtcttaactaagggcaagagagccctgacccctcccgttaacgacctaaaatactcctggaagacatggggtaaagctaagatatttacgccagaagccagaaattctaccttcctcatcgatggccccgacacttcggagtgccctaacgaacgccgggcatggaatttctttgaggtggaggattacgggttcggaatgtttacaaccaacatttggatgaaattcagagaaggcagctccgaggtatgtgaccataggctgatgtcagctgccatcaaggatcagaaagcggtgcacgccgacatggggtattggattgaaagttctaagaatcaaacatggcagatcgagaaggctagccttatagaagtcaaaacttgcttgtggccaaagacccatacgctgtggtccaacggagtgctcgagtcacagatgctgatcccgcgcagctacgcaggccccttttctcagcacaactatcgacaaggttacgccacacagaccgctgggccttggcacttaggaaaactggagattgatttcggcgaatgcccaggtactaccgttacaatccaggaggactgtgatcatcggggcccctcccttcgtactaccacagccagtgggaagttggtgacgcagtggtgctgtagaagctgcaccatgcctccactcaggtttctgggagaagacggctgttggtatgggatggagattcgccccctatctgagaaagaagagaatatggtcaagtcccaagtgactgcaggacagggcacatcagaaaccttcagtatgggtctgctctgcctgactctttttgttgaggaatgtttgcggagaagggtgacacgaaagcacatgatcctggtcgtagtgataaccttctgcgcgattatcttagggggactcacgtggatggatctgcttcgcgccctgattatgttgggcgacactatgagcggccggatcgggggacagatacatctcgctatcatggccgtttttaaaatgtcgccgggttacgtgctgggcgtcttcctaagaaagctgacctccagggagacagcactcatggtgattgggatggctatgaccactgtattttctatccctcacgacctgatggagcttattgatggaatcagcttgggcctgatattactcaaaattgtgacacatttcgacaacacccaggtcggtacactggccctttcactgactttcatccgtagtaccacgcccttagttatggcatggcgcacaatcatggccgtgtttttcgtggtcaccctcattcccctgtgtcggacttcctgcttgcaaaagcagtctcactgggtggaaatcaccgctctgattttaggggcgcaggccctccctgtttatctgatgacacttatgaaaggagcaagcagaaggtcctggcccctgaatgagggcataatggctgtaggcttggtgtcactcctggggagcgccctactgaagaacgatgtcccacttgccggacctatggtggctggtggcctcctgttggcagcctacgttatgagtgggtcttccgcggacctgagcttagaaaaggctgccaatgtgcaatgggatgagatggcagacatcactggatcgtcacccattatcgaagtcaaacaggatgaggacggctcttttagtattcgagatgtggaggaaaccaacatgatcacgctcctggtaaaacttgccctgataacagtctccggtttgtacccactcgctatcccggtgaccatggcactgtggtatgtttggcaagtgaaaactcagcggagcggggccctatgggacgtcccttctcccgcggctacacaaaaggccaccctgagcgagggagtgtaccgcattatgcagagaggccttttcggcaaaactcaggttggggtgggaatccacatggaaggtgtctttcatacaatgtggcacgtgaccaggggctccgtaatttgtcatgagacggggcggctcgaaccatcatgggcagatgtgcgaaatgacatgatcagttatggaggcggttggagactgggggataagtgggacaaggaggaggacgttcaggtcttggccatagaacccggcaagaaccctaagcacgtgcaaactaaaccaggcttattcaagaccctgacaggcgagattggggctgtgaccctcgattttaaacccggaacaagcggttctcctatcatcaataagaaaggcaaggtcattgggctgtacggaaacggcgtagtgactaagtccggtgactatgtttcagccataacccaggcagaacgcatcggggagccggattacgaggtggacgaagatattttcaggaaaaagcgtcttacgatcatggacctgcatccaggagctggcaaaacaaagcggattttgcccagtatcgtcagagaggccctaaaaaggcgcctgcgaactctcatactggcgcctaccagagtggttgccgcagaaatggaggaagcacttcggggcttaccaatcaggtatcagacacccgccgtaaagagcgagcacaccgggcgcgagattgtcgatctgatgtgccacgctacttttaccacacgtctcttgtcctctacgagagtgcctaattacaacctgatcgtaatggacgaagcacatttcactgatccgtgctcggtggccgcccggggatacattagcaccagggttgagatgggtgaagctgcggcaatctttatgacagccacaccaccaggctcaatagaccctttcccccagtccaatagtccaattgaggatatcgaacgcgagatccctgagcgatcttggaacactgggttcgactggattacagactatcaaggaaagaccgtctggtttgtgcccagcatcaaagctggcaatgatatagccaactgtctcagaaagtccggtaaaaaggtgattcagctgtcacggaaaacgttcgacactgaatacccaaagacaaaacttaccgattgggactttgtcgttaccactgatatctctgagatgggggcaaacttcagggccggccgcgtgattgacccgagaaggtgcctgaaacctgtaatcttgacagatggacccgaacgggtgatactagctggcccaattcccgtcacccctgcgagcgccgcacagcgtcgcgggcgaatcggaagaaatccagctcaagaggacgatcagtatgtgtttagtggtgaccccctgaagaacgatgaagaccacgcccattggacagaggcaaaaatgctcttagataatatctacactcctgagggcattatcccgacgctgttcgggccagaaagggagaagacccaggccattgacggagaatttcggcttcgcggcgagcagagaaaaacattcgttgagctgatgaggcggggtgacctccccgtgtggttgtcctataaggtcgctagcgccgggatatcttacaaggatcgagaatggtgttttactggcgagagaaacaatcaaatcctggaagagaacatggaagtagagatttggacccgcgagggagagaagaagaaactcaggcctaagtggctggacgcgcgggtgtatgcagatcccatggcccttaaagacttcaaggagtttgcttcaggccgtaagtccatcacactagatatcctgaccgaaattgccactttgccaacgtacttaagtagcaaagctaagctggcactcgacaatatagttatgctgcacaccacagagaaaggtgggagggcctaccagcacgctcttaacgaactgcctgagtcgctcgagactttgatgctggtggccctactgggggcaatgaccgcgggcatcttcctctttttcatgcaggggaagggaattggcaaactttctatgggtctgatcgccattgctgtcgcctccgggttattgtgggtggcagaaatccagccccaatggatagctgccagcatcattctggagttctttctcatggtcctgcttatcccagaacctgagaagcagaggacaccgcaggataatcagctgatttatgtgatcctcaccatattgactattatcggcctgattgcagccaacgaaatgggattaatcgagaaaacaaagacggacttcggcttttaccaagttaagaccgagaatactatactagatgtggacctgcgccccgcttcagcgtggacactctatgccgtagcaaccaccatccttacaccaatgctgcggcatactattgaaaacacgagtgctaatttgtctctggccgccatcgcaaaccaggctgccgtgctcatggggctgggaaaaggctggcctcttcaccgaatggatctcggtgtccccctgttggcgatggggtgctactcccaggttaatccaaccacactgactgctagcttagtgatgctactggtccattatgccattatcggacctggcctccaggcaaaggccaccagagaggctcagaaaaggacagcagccggtataatgaagaaccccaccgtggacggcattactgtaatcgatcttgaaccgatctcatacgacccaaaattcgagaagcagctgggacaggtgatgttgctggttctctgtgtgggacaactgcttttaatgcgcacgacatgggcgctgtgcgaggtcctcaccttggctactggccctgtgatgaccctgtgggaagggaaccccggacggttttggaatacaactattgccgtcagtaccgcaaacatcttcagaggcagctatctagccggtgctgggctggccttttccctcataaagaatgcacagacaccacgtaggggaacgggcaccactggtgagacacttggcgaaaaatggaagcggcagctgaactctttggaccgcaaagagttcgaagagtacaagcgaagcgggattctggaggtggatagaaccgaagctaaatccgccctcagggacggatcaaagatcaagtacgcggtttctcggggcagttcgaaaattcgctggatcgtagagagagggatgataaagcccaaaggaaaggtggtcgatctgggctgtggtagaggcgggtggagctattacatggccactcttaaaaatgtgacagaagttaaggggtataccaagggcgggcctggacacgaggaaccgatccccatggcaacgtacggttggaacctagtgaaactgcattccggcgtcgacgtgttttataagccaaccgagcaggtagatacactcctatgcgacattggggagtcttcaagcaatcctactatcgaagagggacgaaccctgcgggtgttgaaaatggttgaaccctggctgtccagtaagcctgagttctgtattaaagtcctcaacccatacatgcccacagtgatcgaagaacttgagaagctgcaacgtagacacggcggttctttggtgcgctgccctctgagcagaaattcaactcacgaaatgtattgggtctccggggctagtggaaacattgttagctctgtgaataccatctccaaaatgctcttaaaccggtttacaaccagacatcgcaagccaacttacgagaaggatgtagacctgggcgccggcacgaggtcagtgagcacagaaatagagaaacccgatatgaccattatcgggcgacggcttcagagactgagggaggaacacaaggagacttggcattacgaccacgaaaatccgtatcgcacctgggcataccacggatcgtatgaggctccttctacaggtagtgcctccagcatggtcaacggcatcgtgaaactactcacgaagccatgggatgttattcccatggtgacccagctggccatgactgacacaacccctttcgggcagcaacgtgtctttaaagaaaaggtggacactcggacaccacagcccaagccgggaaccagaatgataatgacaactaccgcgaattggttgtgggctctgctcggcaaaaagaaatcacctaggctttgtacgcgcgaggagttcatctccaaggtacgatctaacgcagccattggtgctgttttccaggaagaacaggggtggaccagcgccagtgaagcagtgaatgattcccggttttgggagctggtcgacaaagaaagagccttacatcaagagggaaagtgcgagagctgcgtgtacaacatgatgggcaagagggagaaaaagctgggcgagttcgggcgcgctaaaggatctagagcgatctggtatatgtggttgggtgcccggtttctcgagttcgaggcactgggctttctaaacgaagatcactggttctcaagggagaatagttggtccggggtggagggagaaggccttcatcgtctgggttacattctcgaggacatcgataagaaagacggggatctgatatatgctgacgatacagccggatgggacactcgaatcaccgaagatgacttgctgaacgaggagctcattacagaacagatggcaccccaccataagactcttgccaaggctatctttaaactgacctaccagaataaggtcgttaaagtgttacgcccaacgcctaagggcgccgtaatggatattatcagcagaaaagaccaacggggctctggacaggtgggaacatacggtctgaacaccttcactaatatggaggtccagttgataaggcagatggaagcggagggcgtgattacacaagacgatatgcagaaccccaaggggctcaaagaacgcgttgagaagtggctgaaggagtgtggagtggacagactagaacggatggcaatctcgggcgatgactgcgtcgtgaaaccacttgatgagaggttttcaaccagcctactcttcctgaatgacatgggtaaggtacgaaaagatatcccccagtgggaaccttccaaggggtggaaaaactggcaggaggttccattttgtagtcaccacttccataagatttttatgaaggacggacgttctttggtggtcccgtgcagaaatcaagatgaattaataggccgcgcccggatcagccagggcgctgggtggtccctgagggagactgcctgtctcggaaaagcatatgctcagatgtggcttctgatgtacttccacagacgcgacctacggctggcctcaatggctatttgcagtgccgtgcccaccgagtggttccctacatctaggacgacctggagcatccatgcacaccaccagtggatgactacagaagatatgctcaaggtttggaaccgagtgtggattgaggacaatccaaacatgaccgacaaaactcccgtccattcctgggaagatatcccttatttgggtaagagagaggacctgtggtgtggctcacttatagggctgagctctcgggcgacatgggccaaaaatatccacaccgctattacgcaagtgaggaacctcatcggaaaggaagagtacgtagattatatgccagccatgaagcgctactccgcaccctttgagagtgaaggcgtgttatga

SEQ ID NO: 15760 - RNA, 9867 nt, synthetic construct
  misc_feature 1..9867: note = derived and/or modified CDS sequence (opt3) from DENV-4__KC762699__SS-prME
  source 1..9867: mol_type = other RNA
agcaccatgaccctgctctgccttatccccactgtgatggccttccacctgtccacgagagacggcgaacctttgatgattgtcgctaagcatgaaagggggcggccattactgtttaagaccacagaaggaataaacaagtgtactctaatcgcaatggatctcggtgaaatgtgcgaagacaccgttacatacaagtgtccgctgcttgtgaataccgaacccgaggatattgactgctggtgtaacctgacttctacatgggtgatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccagcgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtgatactcacgccgtcgggaacgacaccagcaatcacggcgtgacagcaaccataactcctcgttccccatcagtagaggttaagttaccggattacggagaactgacgctcgactgcgagccccgcagtggcattgacttcaacgagatgatccttatgaagatgaaaaagaaaacatggctggtgcataagcagtggtttttggatctacctctgccatggaccgctggggccgacactagcgaagtccactggaattacaaagagagaatggtgaccttcaaggtcccccatgcgaaaaggcaggatgtgacagttctcggatctcaggaaggtgccatgcactccgcactggctggcgccaccgaggtggactcaggggatggaaaccacatgtttgctggccatcttaagtgtaaggtacggatggaaaaactgcgaattaagggtatgagctatactatgtgcagtgggaaattctctatcgacaaggagatggccgagacacaacacggcacgaccgtcgtgaaagttaagtacgaaggagcaggcgccccttgtaaggtgccaatcgagattcgcgatgtcaataaagaaaaggtggtagggagaataatctccagcactcccttcgctgagaacacaaactcggtgaccaatattgagttggaaccgccttttggagactcttatatcgttataggtgtcggcgattccgcgctcacactgcattggttcaggaaagggtcaagtattggaaagatgtttgagagcacttaccggggcgcaaaacgcatggccatcttaggtgaaaccgcttgggacttcgggtccgtgggcggactgtttacgtctctaggcaaggccgtgcaccaggtcttcgggagcgtttataccacaatgtttggaggcgtgtcatggatgatcaggattctcatcggtttcctggtgctttggattgggactaacagtaggaatacctccatggcaatgacatgcatagccgtaggaggcatcactttgtttctgggtttcaccgtccaggctgatatgggctgtgtggttagctggaacgggaaggagctcaaatgcggatctggcatttttgtggtcgacaatgtgcatacgtggacagaacaatacaagttccagcccgagtcaccagcccgtctggcaagtgcgatccttaacgctcacaaagacggggtttgtggaatccggagcaccactcgactggagaatgtgatgtggaagcagattacaaacgaattgaattatgtactctgggagggcggtcacgatctgaccgtcgtggccggggacgtgaaaggagtcttaactaagggcaagagagcactgacccctcccgttaacgatctaaaatactcctggaagacatggggtaaagccaagatatttacgccagaagctagaaattctaccttcctcatcgacggccccgatacttcggagtgccctaacgaacgccgggcctggaatttctttgaggtggaggactacgggttcggaatgtttacaaccaacatttggatgaaattcagagaaggcagctccgaggtatgtgatcataggctgatgtcagcagctatcaaggaccagaaagccgtgcacgcggatatggggtattggattgaaagttctaagaatcaaacatggcagatcgagaaggccagccttatagaagtcaaaacttgcttgtggccaaagacccatacgctgtggtccaacggagtgctcgagtcacagatgctgatcccgcgcagctacgctggccccttttctcagcacaactatcgacaaggttacgcaacacagaccgccgggccttggcacttaggaaaactggagattgacttcggcgaatgcccaggtactaccgttacaatccaggaggattgtgaccatcggggcccctcccttcgtactaccacagctagtgggaagttggtgacgcagtggtgctgtagaagctgcaccatgcctccactcaggtttctgggagaagatggctgttggtatgggatggagattcgccccctatctgagaaagaagagaatatggtcaagtcccaagtgactgccggacagggcacatcagaaaccttcagtatgggtctgctctgcctgactctttttgttgaggaatgtttgcggagaagggtgacacgaaagcacatgatcctggtcgtagtgataaccttctgcgcaattatcttagggggactcacgtggatggacctgcttcgcgcgctgattatgttgggcgacactatgagcggccggatcgggggacagatacatctcgccatcatggctgtttttaaaatgtcgccgggttacgtgctgggcgtcttcctaagaaagctgacctccagggagacagccctcatggtgattgggatggcaatgaccactgtattttctatccctcacgagctgatggaacttattgatggaatcagcttgggcctgatattactcaaaattgtgacacatttcgacaacacccaggtcggtacactggctctttcactgactttcatccgtagtaccacgcccctggttatggcctggcgcacaatcatggcagtgtttttcgtggtcaccctcattcccctgtgtcggacttcctgcttgcaaaagcagtctcactgggtggagatcaccgccctgattttaggggctcaggcgctccctgtttatctgatgacacttatgaaaggagccagcagaaggtcctggcccctgaatgaaggcataatggcagtaggcttggtgtcactcctggggagcgctctactgaagaacgatgtcccacttgccggacctatggtggccggtggcctcctgttggctgcatacgttatgagtgggtcttccgccgacctgagcttagagaaggcggctaatgtgcaatgggatgaaatggccgacatcactggatcgtcacccattatcgaggtcaaacaggatgaggacggctcttttagtattcgagatgtggaagagaccaacatgatcacgctcctggtaaaacttgcactgataacagtctccggtttgtacccactcgccatcccggtgaccatggctctgtggtatgtttggcaagtgaaaactcagcggagcggggcactatgggacgtcccttctcccgccgcgacacaaaaggctaccctgagcgaaggagtgtaccgcattatgcagagaggccttttcggcaaaactcaggttggggtgggaatccacatggagggtgtctttcatacaatgtggcacgtgaccaggggctccgtaatttgtcatgaaacggggcggctcgagccatcatgggccgatgtgcgaaatgacatgatcagttatggaggcggttggagactgggggataagtgggacaaggaggaagacgttcaggtcttggcaatagagcccggcaagaaccctaagcacgtgcaaactaaaccaggcttattcaagaccctgacaggcgaaattggggccgtgaccctcgattttaaacccggaacaagcggttctcctatcatcaataagaaaggcaaggtcattgggctgtacggaaacggcgtagtgactaagtccggtgactatgtttcagctataacccaggccgagcgcatcggggagccggattacgaagtggacgaggatattttcaggaaaaagcgtcttacgatcatggacctgcatccaggagcaggcaaaacaaagcggattttgcccagtatcgtcagagaagctctaaaaaggcgcctgcgaactctcatactggcccctaccagagtggttgcggccgagatggaagaggcacttcggggcttaccaatcaggtatcagacacccgctgtaaagagcgagcacaccgggcgcgaaattgtcgatctgatgtgccacgccacttttaccacacgtctcttgtcctctacgagagtgcctaattacaacctgatcgtaatggacgaggctcatttcactgatccgtgctcggtggcagcccggggatacattagcaccagggttgaaatgggtgaggccgctgcgatctttatgacagcaacaccaccaggctcaatagaccctttcccccagtccaatagtccaattgaagatatcgagcgcgagatccctgaacgatcttggaacactgggttcgactggattacagactatcaaggaaagaccgtctggtttgtgcccagcatcaaagccggcaatgatatagctaactgtctcagaaagtccggtaaacgggtgattcagctgtcaaggaagacgttcgacactgagtacccaaaaacaaaacttaccgattgggactttgtcgttaccactgatatctctgaaatgggggccaacttccgcgcaggcagagtgattgacccgaggcggtgcctgaagcctgtaatcttgacagatggacccgagcgtgtgatactagccggcccaattcccgtcacccctgctagcgcggcccagcgccgagggagaatcggaaggaatccagcacaagaagacgatcagtatgtgtttagtggtgaccccctgaaaaacgatgaggaccacgctcattggacagaggccaagatgctcttagataatatctacactcctgaaggcattatcccgacgctgttcgggccagagcgggagaagacccaggcaattgacggagagtttcgccttagaggcgagcagaggaagacattcgttgaactgatgcggcgaggtgacctccccgtgtggttgtcctataaagtcgccagcgctgggatatcttacaaggatagagagtggtgttttactggcgaacgcaacaatcaaatcctggaggaaaacatggaggtagagatttggaccagggaaggagagaagaaaaagctccggcctaaatggctggacgcccgtgtgtatgcggatcccatggcacttaaggacttcaaagaatttgcctcaggcagaaagtccatcacactagatatcctgaccgagattgctactttgccaacgtacttaagtagcaaggccaaactggctctcgacaatatagttatgctgcacaccacagaaaaaggtgggagggcataccagcacgcccttaacgagctgcctgagtcgctcgaaactttgatgctggtggctctactgggggccatgaccgcaggcatcttcctctttttcatgcaggggaaaggaattggcaaactttctatgggtctgatcgcgattgccgtcgcttccgggttattgtgggtggccgagatccagccccaatggatagcagctagcatcattctggagttctttctcatggtcctgcttatcccagagcctgaaaaacagcgcacaccgcaggataatcagctgatttatgtgatcctcaccatattgactattatcggcctgattgccgcaaacgagatgggattaatcgagaagacaaaaacggacttcggcttttaccaagttaagaccgaaactacaatactagatgtggacctgcggcccgcctcagcttggaccctctatgcggtagccaccacaatccttactccaatgctgcgacatacgattgagaataccagtgcaaacttgtctctggctgccatcgccaatcaggcagctgtgctcatggggctgggaaagggctggcctcttcacagaatggatctcggtgtccccctgttggccatggggtgctactcccaggttaacccaacaactctgaccgcgagcttagtgatgctactggtccattatgctattatcggacctggcctccaggccaaagcaacaagggaagcccaaaagcgcaccgctgcaggtataatgaaaaatcccactgtggacggcattacggtaatcgatcttgagccgatctcatacgacccaaagttcgagaaacagctgggacaggtgatgttgctggttctctgtgtgggacaactgcttttaatgcggacaacctgggccctgtgcgaagtcctcactttggcgaccggccctgtgatgacactgtgggaggggaaccccggaagattttggaacactaccattgctgtcagtacagccaatatcttccgtggcagctatctagccggtgccgggctggctttttccctcataaagaacgcccagacgccaaggcggggaaccggcactacaggtgaaacccttggcgagaagtggaaacgccagctgaactctttggaccgaaaggagttcgaagagtacaaaagaagcgggattctggaagtggataggactgaggcaaagtccgctctccgggacggatcaaaaatcaagtacgccgtttctcgcggcagttcgaagattagatggatcgtagaaagggggatgataaaacccaagggaaaagtggtcgatctgggctgtggtcgagggggatggagctattacatggcgacattaaagaatgtgaccgaggttaaaggctatacgaagggcgggcctggacacgaagaaccgatccccatggccacctacggttggaatcttgtgaagctgcattccggcgtcgacgtgttttataaaccaacagagcaggtagatactctcctatgcgacattggggaatcttcaagcaaccctaccatcgaggaaggacggacactgcgtgtgttgaagatggttgagccctggctgtccagtaaacctgagttctgtattaaggtcctcaatccatacatgcccactgtgatcgaggagcttgaaaaactgcaaagacgccacggcggttctttggtgaggtgccctctgagccggaactcaacccacgagatgtattgggtctccggggcaagtggaaatattgttagctctgtgaacacaatctccaagatgctcttaaatagatttaccactcgccataggaaaccaacgtacgaaaaggatgtagacctgggcgctggcacacgatcagtgagcaccgagactgagaagcccgatatgaccataattgggcggagacttcagaggctgcgcgaagaacacaaagaaacatggcattacgaccaggagaacccgtatcgtacgtgggcctaccacggatcgtatgaagcaccttctaccggtagtgcttccagcatggtcaatggcgtggttaagctactcactaaaccatgggatgtgatccccatggtcacacagctggccatgaccgacactacacctttcgggcaacagcgggtgtttaaggagaaagtagacaccagaacaccacagcccaagccgggaactaggatgatcatgaccacgaccgccaactggttgtgggcgctgctcggcaagaaaaagtcacctcgcctttgtacacgagaggagttcatttccaaagttcggtctaatgctgcaataggtgccgtgttccaggaggaacaagggtggactagcgctagtgaggccgtcaacgattccagattttgggaactggtggacaaggagagggcattacaccaggagggaaaatgcgaaagctgcgtgtacaatatgatgggcaagcgcgagaagaaactgggcgagttcgggagagccaagggatctcgggctatctggtatatgtggttgggtgcgaggtttctcgagttcgaagccctgggctttctaaacgaggatcattggttctcacgtgagaacagttggtccggggtcgaaggagagggccttcaccgactgggttacattctcgaagacatcgataaaaaggacggggatctgatttatgcagacgataccgctggatgggacacacgcatcactgaggatgacttgctgaatgaggaactcataaccgagcagatggcaccccatcacaaaacgcttgcaaaggccatctttaagctgacataccaaaacaaagttgtgaaggtattaagaccaacccctaaaggcgctgtgatggatattatcagccggaaggaccagaggggctctgggcaggtcggaacttacggtctgaatacattcaccaacatggaagtgcagttgattcgccaaatggaggccgaaggcgttatcactcaggacgatatgcagaatcccaaagggctcaaggagagagtggagaaatggctgaaggaatgtggagtcgaccggctaaagaggatggcgatatcgggcgatgactgcgtggtaaaaccacttgatgagcgattttcaaccagcctactcttcctgaacgacatgggtaaggttcgtaaagatattccccagtgggaaccttccaaggggtggaaaaattggcaagaggtgccattttgtagtcatcacttccacaagatctttatgaaggacggaagatctttggtcgtgccgtgccgcaaccaggatgaattaatcggccgggcaaggattagccagggcgccgggtggtccctgagagagacagcttgtctcggaaaagcctatgcacagatgtggtcacttatgtacttccatcgccgggacctgaggctagctagtatggccatatgctctgctgttcccacggagtggttccctaccagccgaactacatggtccatccacgcccatcaccaatggatgaccactgaagatatgctgaaggtgtggaatagagtctggattgaggacaacccaaatatgacagacaaaacccccgtgcactcatgggaagatatcccttatctcggtaagcgggaggacttgtggtgtggcagcctgattgggctttcttccagggcaacgtgggcgaaaaacatccatacagccataacccaggtacgcaatctgatcggaaaggaagagtacgtggattatatgccagctatgaagcgttacagtgccccctttgagagcgaaggcgtcctctga

SEQ ID NO: 15761 - RNA, 9867 nt, synthetic construct
  misc_feature 1..9867: note = derived and/or modified CDS sequence (opt3) from DENV-4__JQ915085__SS-prME
  source 1..9867: mol_type = other RNA
agcaccatgacactgctctgccttatacccactgtgatggccttccacctgtccacgagggacggagaacctttgatgattgtcgctaagcatgaaagggggcggccattactgtttaaaaccacagagggaataaacaagtgtactctgatcgcaatggatctcggtgaaatgtgcgaggacaccgttacatacaaatgtccgctgcttgtgaataccgaacccgaggatattgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtgatactcacgccgtcgggaacgacaccagcaatcacggcgtgacagcaaccataactcctcgttccccatcagtagaggttaagttaccggattacggagaactgacgctcgactgcgagccccgcagtggcattgacttcaacgagatgatccttatgaagatgaaaaagaaaacatggctggtgcataagcagtggtttttggatctacctctgccatggaccgctggggccgacactagcgaagtccactggaattacaaagagagaatggtgaccttcaaggtcccccatgcgaaaaggcaggatgtgacagttctcggatctcaggaaggtgccatgcactccgcactggctggcgccaccgaggtggactcaggggatggaaaccacatgtttgctggccatcttaagtgtaaggtacggatggaaaaactgcgaattaagggtatgagctatactatgtgcagtgggaaattctctatcgacaaggagatggccgagacacaacacggcacgaccgtcgtgaaagttaagtacgaaggagcaggcgccccttgtaaggtgccaatcgagattcgcgatgtcaataaagaaaaggtggtagggagaataatctccagcactcccttcgctgagaacacaaactcggtgaccaatattgagttggaaccgccttttggagactcttatatcgttataggtgtcggcgattccgcgctcacactgcattggttcaggaaagggtcaagtattggaaagatgtttgagagcacttaccggggcgcaaaacgcatggccatcttaggtgaaaccgcttgggacttcgggtccgtgggcggactgtttacgtctctaggcaaggccgtgcaccaggtcttcgggagcgtttataccacaatgtttggaggcgtgtcatggatcattagaatcctcattggtttcctggtgctttggatagggactaacagtaggaatacctccatggcaatgacatgcatcgccgtaggaggcattactttgtttctgggtttcaccgtccaggctgatatgggctgtgtggttagctggaacgggaaggagctcaaatgcggatctggcatctttgtggtcgacaatgtgcatacgtggacagaacaatacaagttccagcccgagtcaccagcccgtctggcaagtgcgatccttaacgctcacaaagacggggtttgtggcattcggagcaccactcgactggagaatgtgatgtggaagcagataacaaacgaattgaattatgtactctgggagggcggtcacgatctgaccgtcgtggccggggacgtgaaaggagtcttaactaagggcaagagagcactgacccctcccgttaacgatctaaaatactcctggaagacatggggtaaagccaagatctttacgccagaagctagaaattctaccttcctcattgacggccccgatacttcggagtgccctaacgaacgccgggcctggaatttctttgaggtggaggactacgggttcggaatgtttacaaccaacatctggatgaaattcagagaaggcagctccgaggtatgtgatcataggctgatgtcagcagctattaaggaccagaaagccgtgcacgcggatatggggtattggatcgaaagttctaagaatcaaacatggcagatagagaaggccagccttatcgaagtcaaaacttgcttgtggccaaagacccatacgctgtggtccaacggagtgctcgagtcacagatgctgattccgcgcagctacgctggccccttttctcagcacaactatcgacaaggttacgcaacacagaccgccgggccttggcacttaggaaaactggagatcgacttcggcgaatgcccaggtactaccgttacaattcaggaggattgtgaccatcggggcccctcccttcgtactaccacagctagtgggaagttggtgacgcagtggtgctgtagaagctgcaccatgcctccactcaggtttctgggagaagatggctgttggtatgggatggagatccgccccctatctgagaaagaagagaatatggtcaagtcccaagtgactgccggacagggcacatcagaaaccttcagtatgggtctgctctgcctgactctttttgttgaggaatgtttgcggagaagggtgacacgaaagcacatgatactggtcgtagtgattaccttctgcgcaatcattttagggggactcacgtgggttgacctgcttcgcgcgctgatcatgttgggcgacactatgagcggccggatagggggacagatccatctcgccattatggctgtgtttaaaatgtcgccgggttacgtcctgggcgtgttcctaagaaagctgacctccagggagacagccctcatggtaatcgggatggcaatgaccactgtgttttctattcctcgtgatctgatggagcttatcgacggaatcagcttgggcctgattttactcaaaatcgtcacacacttcgataacacccaggttggtacactggctctttcactgactttcatccgcagtaccacgcccttagtgatggcctggcggacaattatggtggtctttttcgtggttaccctcatccccctgtgtagaacttcctgcttgcaaaagcagtctcattgggtagaaattaccgcactgatattaggggcccaggctctccctgtgtatctgatgacacttatgaaaggagcgagcaggcgatcctggcccctgaatgagggcatcatggccgtcggcttggtgtcactcctggggagcgcactactgaagaacgacgttccacttgctggacctatggtggccggtggcctcctgttggccgcttacgtcatgagtgggtcttccgcagatctgagcttagaaaaggccgcgaatgtgcaatgggacgagatggctgatattactggatcgtcacccatcattgaagtaaaacaggacgaggatggctcttttagtatccgggacgtcgaggaaaccaacatgataacgctcctggtgaaacttgccctgatcacagtttccggtttgtacccactcgcaattccggtgaccatggccctgtggtatatctggcaggtcaaaactcagcgcagcggggctctatgggatgtgccttctcccgcagccattcaaaaggcgacactgagcgagggagtttacagaatcatgcagaggggccttttcggcaaaacccaggtgggggtcggaatacacatggaaggtgtgtttcacactatgtggcatgtaacacggggctccgtgatttgtcacgagaccgggcgactcgaaccatcatgggctgacgttagaaatgatatgatcagttatggaggcggttggcgcctgggggacaagtgggacaaggaggaggatgtccaggtgttggccatcgaacccggcaagaaccctaagcatgtgcaaacgaaaccaggcttattcaagactctgaccggcgagattggggcagtcacactcgactttaaacccggaaccagcggttctcctataatcaataagaaaggcaaggtaattgggctgtacggaaacggcgtggttacaaagtccggtgattatgtgtcagccatcactcaggctgaaaggattggggagccggactacgaggtcgatgaagacatcttccgtaaaaagcggcttaccataatggatctgcacccaggagccggcaaaacgaagagaatcttgcccagtattgtgagggaggcactaaaacgccgactgagaacactcatcctggctcctactcgggttgtggccgcggaaatggaggaagcccttaggggcttaccaattcgctatcagacccccgcagtcaagagcgagcatacagggcgtgagatcgtggacctgatgtgccacgctacctttactaccagactcttgtcctctacacgggtacctaattacaacctgatagtgatggatgaagcccacttcacggacccgtgctcggttgctgcaaggggatacattagcactcgcgtcgagatgggtgaagccgccgctatctttatgaccgcgacacccccaggctcaatcgatcctttcccccagtccaatagtccaattgaggacatcgaacgagagatacctgagagatcttggaacaccgggttcgactggattactgattatcaaggaaagacagtgtggtttgtgcccagcatcaaagcaggcaatgacattgccaactgtctccggaagtccggtaaaaaggtcatccagctgtcaaggaaaaccttcgatacggaatacccaaagactaaacttacagactgggattttgttgtgaccaccgacatatctgagatgggggctaacttccgcgccggcagagtaattgatccgaggcggtgcctgaaacctgtgatcttgactgacggacccgaacgtgtcatcctagcaggcccaattcccgtgactcctgcaagcgctgcgcagcgccgagggagaatcggaaggaatccagcccaagaggatgaccagtatgtttttagtggtgatcccctgaagaacgacgaagatcatgcacactggaccgaggctaaaatgctcttagacaatatttacacacctgagggcataatcccgactctgttcgggccagaacgggagaagacgcaggccattgacggagaatttcgccttagaggcgagcagaggaaaaccttcgtggagctgatgcggcgaggtgatctccccgtctggttgtcctataaggtagcaagcgccgggatctcttacaaggacagagaatggtgttttacaggcgagcgcaacaatcaaatcctggaagagaacatggaagtggagatttggactagggagggagagaagaagaaactccggcctaagtggctggatgctcgtgtttatgccgaccccatggcgcttaaagatttcaaggagtttgcatcaggcagaaagtccataaccctagacatcctgacagaaattgccaccttgccaacttacttaagtagcaaagctaagctggccctcgataatatcgtgatgctgcatacggctgagaaagggggaagggcataccagcacgcccttaacgaactgcctgagtcgctcgagaccttgatgctggtcgctctactgggtgccatgacagcaggcattttcctctttttcatgcaggggaagggaatcggcaaactttctatgggtctgatagcgatcgccgtggcttccgggttattgtgggtcgccgaaattcagccccaatggatcgcagctagcattatcctggagttctttctcatggtgctgcttataccagaacctgagaagcagcgcactccgcaggacaatcagctgatttatgttatcctcaccattttgacaatcataggcctgatcgccgcaaacgaaatgggattaattgagaaaaccaagactgatttcggcttttaccaagtgaagacagagacgaccatcctagacgtagatctgcggcccgcctcagcttggactctctatgcggtggccacaaccattcttaccccaatgctgcgacacacaatcgaaaatacaagtgcaaacttgtctctggctgccatagccaatcaggcagctgtcctcatggggctgggaaaaggctggcctcttcatagaatggacctcggtgttcccctgttggccatggggtgctactcccaggtgaacccaacgaccctgacagcgagcttagtcatgctactggtgcactatgctattatcggacctggcctccaggccaaggcaactagggaggcccaaaaacgcaccgctgcaggtatcatgaagaatcccacagtagatggcattaccgtgatcgaccttgaaccgatatcatacgacccaaaattcgagaagcagctggggcaggttatgttgctggtgctctgtgtcggacaactgcttttaatgcggactacgtgggccctgtgcgaggtgctcacattggcgaccggccctattatgactctgtgggaagggaaccccggaagattttggaacaccacaatcgctgtcagtactgccaatattttccgtggcagctatctagccggtgccgggctggctttttccctcatcaagaacgcccagaccccaaggcggggaacaggcacgaccggtgagactcttggcgaaaaatggaagcgccagctaaattctttggatcgaaaagagttcgaagagtacaagagaagcgggatactggaggtggacaggacagaagcaaaatccgctctccgggatggatcaaagatcaagcatgccgtttctcgcggcagttcgaaaattagatggatcgtagagagggggatgattaagcccaaaggaaaggtggtcgacctgggctgtggtcgagggggatggagctactatatggcgaccctgaaaaacgtgactgaagttaagggctacacaaagggcgggcctggacacgaggaaccgatccccatggccacctatggttggaatcttgtgaaactgcattccggcgtcgatgtgttttacaagccaacggagcaggtagacaccctcctatgcgatattggggagtcttcaagcaaccctacaatcgaagagggacggactctgcgtgtgttgaaaatggttgaaccctggctgtccagtaagcctgagttctgtataaaagtcctcaatccatatatgcccaccgtgattgaagaacttgagaagctgcaaagacgccacggcggttctttggtgaggtgccctctgagccggaactcaacacacgaaatgtactgggtctccggggcaagtggaaatatcgttagctctgtgaacactatctccaaaatgctcttaaatagatttaccacacgccataggaagccaacctatgagaaggacgtagatctgggcgctggcactcgatcagtgagcacggaaacagagaaacccgacatgaccattatagggcggagacttcagaggctgcgcgaggaacacaaggagacttggcattacgatcaggaaaacccgtaccgtacctgggcctatcacggatcgtacgaggcaccttctacaggtagtgcttccagcatggtcaatggcgtggttaaactactcacgaagccatgggacgtgatccccatggtcacccagctggccatgactgacacaacccctttcgggcaacagcgggtgtttaaagaaaaggtagatactagaacaccacagcccaagccgggaaccaggatgattatgacaactaccgccaactggttgtgggcgctgctcggcaaaaagaaatcacctcgcctttgtacgcgagaggagttcatctccaaggttcggtctaatgctgcaattggtgccgtgttccaggaagaacaagggtggaccagcgctagtgaagccgtcaacgactccagattttgggagctggtggataaagaaagggcattacaccaggagggaaagtgcgagagctgcgtgtataatatgatgggcaagcgcgagaaaaagctgggcgagttcgggagagccaaaggatctcgggctatctggtacatgtggttgggtgcgaggtttctcgagttcgaggccctgggctttctaaacgaagaccattggttctcacgtgagaacagttggtccggggtcgagggagaaggccttcaccgactgggttatatactcgaggatatcgacaagaaagatggggacctgatttacgcagatgacacagctggatgggatactcgcatcaccgaagacgatttgctgaatgaggagctcattacagaacagatggccccacatcacaagactcttgcaaaggccatctttaaactgacctatcaaaacaaggttgtgaaagtattaagaccaacgcctaagggcgctgtgatggacataattagccggaaagaccagaggggctctgggcaggtcggaacatacggtctgaataccttcactaacatggaggtgcagttgatccgccaaatggaagccgagggcgttatcacacaggatgacatgcagaatcccaaggggctcaaagaaagagtggagaagtggctgaaggagtgtggagtcgatcggctaaaaaggatggcgatttcgggcgacgattgcgtggtaaagccacttgacgaacgattttcaaccagcctactcttcctgaacgatatgggtaaagttcgtaaggacataccccagtgggagccttccaaagggtggaagaattggcaagaagtgccattttgtagtcatcacttccacaagatctttatgaaagatggaagatctttggtcgtgccgtgccgcaaccaggacgagttaattggccgggcaaggatcagccagggcgccgggtggtccctgagagaaactgcttgtctcggaaaggcctacgcacagatgtggtcacttatgtatttccatcgccgggatctgaggctagctagtatggccatttgctctgctgttcccaccgagtggttccctacaagccgaacgacctggtccatccacgcccatcaccaatggatgactacagaggacatgctgaaagtgtggaatagagtctggatagaagacaacccaaatatgaccgataagactcccgtgcactcatgggaggacatcccttacctcggtaaacgggaagatttgtggtgtggcagcctgattgggctttcttccagggcaacatgggcgaagaacatccataccgccattacgcaggtacgcaatctgatcggaaaggaggaatatgtggactacatgccagctatgaaacgttatagtgccccctttgagagcgagggcgtcctctga

SEQ ID NO: 15762 - RNA, 9867 nt, synthetic construct
  misc_feature 1..9867: note = derived and/or modified CDS sequence (opt3) from DENV-4__JQ915088__SS-prME
  source 1..9867: mol_type = other RNA
agcaccatgaccctgctctgccttatccccactgtgatggcattccacctgtccacgcgggacggcgagcctttgatgattgtcgctaagcatgaaagggggcggccattactgtttaagaccacagagggaataaacaagtgtactctaatcgcaatggatctcggtgaaatgtgcgaggacaccgttacatacaaatgtccgctgcttgtgaataccgaacccgaggatattgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggcttacatgattggccagactggcatccagagaatagtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgaccacaatggctcaggggaagcctaccctggattttgaactaacgaagactacagccaaagaggtggcgctcctgcgcacctactgtatcgaagcaagtatttccaatatcactacagccacccgatgcccaacgcaaggagagccctatcttaaggaggaacaggaccagcagtacatttgtagaagggatgtcgttgaccggggctggggcaacgggtgcggactgttcggtaaaggcggggtggtaacctgcgctaagtttttgtgttctggaaaaatcacaggcaatctcgtgcaaatagagaacctggaatatactgtcgtggttaccgtgcataatggtgatacacacgccgtcgggaacgacactagcaatcacggcgtgaccgcaacaattacccctcgttccccatcagtagaggttaagttaccggattacggagaactgactctcgactgcgagccccgcagtggcatcgacttcaacgagatgattcttatgaagatgaaaaagaaaacgtggctggtgcataagcagtggtttttggatctacctctgccatggacagctggggccgacaccagcgaagtccactggaattacaaagagagaatggtgactttcaaggtcccccatgcgaaaaggcaggatgtgaccgttctcggatctcaggaaggtgccatgcactccgcactggctggcgccacagaggtggactcaggggatggaaaccacatgtttgctggccatcttaagtgtaaggtacggatggaaaaactgcgaatcaagggtatgagctataccatgtgcagtgggaaattctctatcgacaaggagatggccgagactcaacacggcacaacggtcgtgaaagttaagtacgaaggagcaggcgccccttgtaagattccaatagagatccgcgatgtgaataaagaaaaggtcgtggggagaattatctccagcacccccttcgctgagaacactaactcggtaataaatattgagttggaaccgccttttggagactcttatatcgtgatcggtgttggcgattccgcgctcacactgcattggttcaggaaagggtcaagtattggaaagatgtttgagagcacctaccggggcgcaaaacgcatggccatcttaggtgaaacagcttgggacttcgggtccgtcggcggactgtttacttctctaggcaaggccgtgcaccaggtgttcgggagcgtctataccacgatgtttggaggcgtttcatggatgattagaatactcatcggtttcctggtgctttggattgggaccaacagtaggaatacatccatggcaatgacttgcatcgccgtgggaggcatcaccttgtttctgggtttcacagtacaggctgatatgggctgtgtcgtgagctggaacgggaaggagctcaaatgcggatctggcatttttgttgtggacaatgtccatacttggaccgaacaatacaagttccagcccgagtcaccagcccgtctggcaagtgcgatacttaacgctcacaaagacggggtgtgtggaatccggagcacgacacgactggagaatgttatgtggaagcagattaccaacgaattgaattatgtgctctgggagggcggtcacgatctgactgtagtcgccggggacgtgaaaggagtgttaacaaagggcaagagagcactgacccctcccgtcaacgatctaaaatactcctggaagacttggggtaaagccaagatctctaccccagaagctagaaattcgacatttctcattgacggccccgatacgagcgagtgccctaacgaacgccgggcctggaatttcttcgaggttgaggactacgggtttggaatgttcaccactaacatctggatgaaatttagagaaggctcctcagaggtgtgtgatcataggctgatgagtgcagctataaaggaccagaaagccgtacacgcggatatggggtattggatcgaatctagcaagaatcaaacatggcagattgagaaggcctcccttatcgaagtgaaaacctgcttgtggccaaagacacatactctgtggtcaaacggagtcctcgagagccagatgctgattccgcgctcttacgctggccccttctcccagcacaactatcgacaaggttacgcaacccagacggccgggccttggcacttaggaaaactggagatcgactttggcgaatgcccaggtacaaccgtgaagatacaggaggattgtgaccatcggggccccagtcttcgtactaccacagctagcgggaaattggttactcagtggtgctgtagatcttgcaccatgcctccactcaggttcctgggagaagatggctgttggtatgggatggagattcgccccctatccgagaaggaagagaatatggtgaagtcacaagtcacagccggacagggcacgagtgaaacctttagcatgggtctgctctgcctgactcttttcgtggaggaatgtttgcggagaagggttacacgaaaacacatgatcctggtggtcgtaattaccttttgcgcaatcatattagggggactcacttggatggacctgcttcgcgcgctgatcatgttgggcgacacaatgtcgggccggattgggggacagatccatctcgccattatgaccgtgttcaagatgtccccgggttacgttctgggcgtgtttctaagaaaactgacgtctagggagactgctctcatggtcatcgggatggccatgaccacagtgttcagcatacctcacgatctgatggagcttattgacggaatctcattgggcctgatcttactcaagattgtaacccattttgataacactcaggtgggtacactggcacttagtctgaccttcatgcgttccacaactcccctagtcatggcttggcgcaccatcatggccgttttctttgtgattacgctcatacccctgtgtcggacatcttgcttgcaaaaacagagccactgggtggaaatcaccgcactgattttaggggcccaggctctccctgtctatctgatgactcttatgaagggagcgtccagaaggtcatggcccctgaatgagggcatcatggccgtgggcttggttagcctcctggggagtgcactactgaagaacgacgtaccacttgctggacctatggtggccggtggcctcctgttggccgcttacgtcatgtctgggtccagcgcagatctgtcgttagaaaaagccgcgaatgtgcaatgggacgagatggctgatattaccggatcatctcccatcatagaagttaagcaggacgaggatggcagtttctccatccgagacgtggaggaaacaaacatgattactctcctggtcaaacttgccctgatcaccgtgagcggtttgtacccactcgcaattccggtaacgatggccctgtggtatatctggcaggtcaagacacagcggtctggggctctatgggatgtgcctagccccgcagccacccaaaaagcgactctgtccgagggagtttaccgcataatgcagagaggcctttttggcaagacacaggtgggggtcggcattcacatggaaggtgtgttccataccatgtggcacgttactaggggctcagtgatctgtcatgagacagggcggctcgaaccaagttgggctgacgtccgaaatgatatgatcagctatggaggcggttggagactgggggacaagtgggacaaagaggaggatgtgcaggtattggccattgaacccggaaagaaccctcgccacgtgcaaaccaaaccaggcttatttaagacgctgactggcgagataggggcagttaccctcgacttcaaacccggaacatctggttcccctatcattaataagaaaggcaaggtcatcgggctgtacggaaacggcgtggtgaccaagtcaggtgattatgtcagtgccattacacaggctgaaaggatcggggagccggactacgaggtagatgaagacatatttcgtaaaaagcggcttactatcatggatctgcatccaggagccggcaaaaccaagagaattttgcccagcatcgtgagggaggcactaaaacgccgactgagaacgctcattctggctcctacacgggttgtggccgcggaaatggaggaagcccttaggggcttaccaatccgctatcagactcccgcagtcaagtccgagcacaccgggcgtgagatagtggacctgatgtgccacgctacattcaccactagactcttgtcttcgacccgggttcctaattacaacctgattgtgatggatgaagcccattttacagacccgtgcagcgtcgctgcaaggggatacatctcaacgcgcgtggagatgggtgaagccgccgctatcttcatgactgcgacaccaccaggctccattgatccttttccccagagtaattctccaatcgaggacatagaacgagagattcctgagagaagctggaacacagggttcgactggatcaccgattatcaaggaaagactgtatggttcgtgccctccattaaagcaggcaatgacatcgccaactgtctccggaagtcaggtaaaagggttatacagctgtctcgcaagacatttgataccgaatacccaaaaacgaaacttactgactgggatttcgtcgtgacaaccgacattagcgagatgggggctaactttagagccggcagggtgatcgatccgcggcgttgcctgaagcctgtcatcttgaccgacggacccgaacgcgttattctagcaggcccaatccccgtgactcctgccagtgctgcgcagcgaagagggaggattggacggaatccagcccaagaggatgaccagtatgtattctccggtgatcccctgaaaaacgacgaagatcacgcacattggacagaggctaagatgctcttagacaatatatacacccctgagggcatcattccgacactgtttgggccagaacgcgagaaaactcaggccatcgacggagagttcagacttaggggcgagcagcggaagacgtttgtggagctgatgcgaagaggtgatctccccgtctggttgagctataaagtggcatctgccgggatctcatacaaggaccgcgaatggtgtttcaccggcgagaggaacaatcaaattctggaagagaacatggaagttgagatatggacacgggagggagaaaagaaaaagctccgtcctaaatggctggatgctagagtgtatgccgaccccatggcgcttaaggattttaaagagttcgcatccggcaggaagagtactaccctagacatcctgacagaaattgccaccttgccaacttacttaagctcgaaggctaaactggccctcgataatatcgtcatgctgcacacgaccgagaaaggtgggcgcgcttaccagcacgcacttaacgaactgcctgagtctctcgagacattgatgctggtagccctactgggggctatgactgccggcatttttctcttctttatgcaggggaaaggaatcggcaaactttccatgggtctgatagcaatggcggtggccagcgggttattgtgggttgctgaaatccagccccaatggattgccgcatcaatcattctggagttcttcctcatggtgctgcttatcccagaacctgagaaacagcggaccccgcaggacaatcagctgatatatgtcattctcacaatcttgaccattatcggcctgatagctgccaacgaaatgggattaatcgagaagactaaaacagattttggcttctaccaagtgaagacggagaccactattctagacgtcgatctgcgacccgcaagtgcctggacactctatgctgtggcgaccaccatccttacaccaatgctgagacatactattgaaaatacgtctgccaacttgtccctggcagctatcgccaatcaggccgcagttctcatggggctgggaaagggctggcctcttcacaggatggacctcggtgtgcccctgttggctatggggtgctacagccaggtaaacccaaccacactgactgcctcattagtgatgctactgatacattatgcgattatcggacctggcctccaggctaaagccacccgcgaggcacaaaagcggacagccgctggtatcatgaaaaatcccaccgtcgatggcattactgttatcgaccttgaaccgataagttacgacccaaagtttgagaaacagctgggacaggtgatgttgctggtcctctgtgtgggacaactgcttttaatgagaacgacatgggcactgtgcgaggtactcaccttggccactggccctattatgaccctgtgggaagggaaccccggacgtttctggaacacaactatcgcggtgagcaccgctaatatttttaggggctcctatctagccggtgcagggctggccttctctctcatcaagaacgctcagacaccacggcgcggaacgggcaccactggtgagacacttggcgaaaagtggaaacgacagctgaatagcttggatagaaaggagtttgaagagtacaaaaggtccgggatactggaggttgaccggaccgaagccaagtcagcactccgcgatggatctaaaatcaagcacgctgtgagtagaggctcgagcaagattaggtggatcgtcgagcgagggatgattaaacccaagggaaaagtggtcgacctgggctgtggtagaggcgggtggtcctactatatggccactttaaagaacgtgacagaagttaaagggtacaccaagggcgggcctggacatgaggaaccgatccccatggcgacgtatggttggaatcttgtaaagctgcactctggcgtggatgtcttctacaaaccaaccgaacaggtggacacactcctatgcgatattggggagtcaagctccaaccctactatcgaagagggacgtaccctgagaatattgaagatggttgaaccctggctgagttctaaacctgagttttgtattaaggtgctcaatccatatatgcccacagtcatcgaggaacttgagaaactgcaacgcaggcacggcggtagcttggtgcggtgccctctgtcaagaaactccactcatgaaatgtactgggtaagtggggccagcggaaatatcgtgtcttccgttaacaccatttcaaagatgctcttaaatcgcttcacaaccaggcaccgaaaaccaacttatgagaaggacgtcgatctgggcgcaggcacgcggagcgtgtcgacagaaaccgagaagcccgacatgactataatcgggagaaggcttcagcgcctgcaggaggaacataaagagacctggcactacgatcaggaaaacccgtaccgtacatgggcttatcacggatcttacgaggcccctagtacgggttccgcaagctcaatggtgaatggcgtcgttaagctactcaccaaaccatgggacgtgattcccatggtaactcaactggctatgacagacaccactccttttgggcagcagcgggtgttcaaggaaaaagtcgatacaagaaccccacagcccaagttgggaacaaggatgatcatgactaccacggccaactggctgtgggccctccttggcaagaaaaagtccccgcgcctgtgtacccgagaggagtttatttctaaagtgcggagcaatgcggctatcggtgcagttttccaagaggaacaggggtggacaagtgcctccgaagctgtgaacgacagcagattctgggagttagtcgataaggaaagggccctgcatcaggagggaaaatgcgagtcttgcgtgtataatatgatgggcaagcgcgaaaagaaattgggcgagtttgggagagcaaagggatcacgggccatatggtacatgtggctcggtgctaggttcctggaatttgaggcgctaggcttccttaacgaagaccactggtttagtcgtgagaactcctggagcggggtagagggagaaggcctgcatcgactcggttatatcctggaggatattgacaaaaaggatggggacttgatctacgccgatgacactgcaggatgggatacccgcattacagaagacgatctgctcaatgaggagcttatcactgaacaaatggctcctcaccataaaaccctggccaaggcaatattcaagttaacgtatcagaacaaagttgtgaaggtcctgagacccacaccaaaaggcgccgtgatggacattatctctcggaaggaccagaggggctcgggacaggtgggaacctacggtttgaatacttttacaaacatggaggtccaactcatccgccagatggaagctgagggcgttattacccaggatgacatgcagaatcctaaagggctgaaggaaagagtggagaaatggctaaaggagtgtggagtagatcggcttaagaggatggccatatcaggcgacgattgcgtggtcaaacccctggacgaacgattcagcacttccctcctgtttttgaacgatatgggtaaggtgcgtaaagacgttccacaatgggagcccagtaaggggtggaaaaattggcaggaagtgcctttctgttctcaccactttcataagatcttcatgaaggatggaaggagcttagtcgtgccatgccgcaaccaggacgagctgattggccgggcgaggatctcccagggcgcagggtggtcactcagagaaaccgcctgtcttggaaaggcttacgcccaaatgtggagtctgatgtattttcaccgccgggatctaaggctggcatctatggctatttgcagcgccgtaccgacagagtggttccccacgtcccgaaccacttggtcaatccatgctcagcaccagtggatgacaaccgaggacatgctcaaggtttggaatagagtgtggatagaagacaaccctaatatgactgataaaacaccagtccacagctgggaggacatcccctacttgggtaagcgggaagatctgtggtgtggctctcttattgggctgtccagtagggccacctgggccaagaacatccatacggcgattacacaggtgcgcaatctcatcggaaaggaggaatatgttgactacatgcctgtgatgaagcgttatagctcgccatccgagtctgagggcgtcttatga

SEQ ID NO: 15763 - RNA, 9867 nt, synthetic construct
  misc_feature 1..9867: note = derived and/or modified CDS sequence (opt3) from DENV-4__JQ915086__SS-prME
  source 1..9867: mol_type = other RNA
agcaccatgacactgctctgccttatcccaactgtgatggccttccacctgtccacgcgggacggcgagcctttgatgattgtcgctaagcatgaaagggggcggccattactgtttaagaccacagagggaataaacaagtgtactctaatcgcaatggatctcggtgaaatgtgcgaggacaccgttacatacaagtgtccgctgcttgtgaataccgaacccgaggatattgactgctggtgtaacctgacttctacatgggtgatgtatggaacatgcacgcagtcaggggagcgccgacgtgaaaagagaagtgtggccttgactcctcacagcggaatgggcctcgagaccagggcggaaacatggatgtcctctgagggtgcttggaagcatgcccagcgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtgatactcacgccgtcgggaacgacaccagcaatcacggcgtgacagcaaccataactcctcgttccccatcagtagaggttaagttaccggattacggagaactgacgctcgactgcgagccccgcagtggcattgacttcaacgagatgatccttatgaagatgaaaaagaaaacatggctggtgcataagcagtggtttttggatctacctctgccatggaccgctggggccgacactagcgaagtccactggaattacaaagagagaatggtgaccttcaaggtcccccatgcgaaaaggcaggatgtgacagttctcggatctcaggaaggtgccatgcactccgcactggctggcgccaccgaggtggactcaggggatggaaaccacatgtttgctggccatcttaagtgtaaggtacggatggaaaaactgcgaattaagggtatgagctatactatgtgcagtgggaaattctctatcgacaaggagatggccgagacacaacacggcacgaccgtcgtgaaagttaagtacgaaggagcaggcgccccttgtaagatcccaattgagatacgcgatgtgaataaagaaaaggtcgtggggagaatcatttccagcactcccttcgctgagaacacaaactcggtaatcaatatagagttggaaccgccttttggagactcttatattgtgatcggtgttggcgattccgcgctcaccctgcattggttcaggaaagggtcaagtatcggaaagatgtttgagagcacataccggggcgcaaaacgcatggccattttaggtgaaactgcttgggacttcgggtccgtcggcggactgtttacctctctaggcaaggccgtgcaccaggtgttcgggagcgtctatacgaccatgtttggaggcgtttcatggatgatcaggattctcataggtttcctggtgctttggatcgggacaaacagtaggaatacttccatggcaatgacctgcattgccgtgggaggcatcacattgtttctgggtttcactgtacaggctgatatgggctgtgtcgtgagctggaacgggaaggagctcaaatgcggatctggcatctttgttgtggacaatgtccatacctggacggaacaatacaagttccagcccgagtcaccagcccgtctggcaagtgcgattcttaacgctcacaaagacggggtgtgtggaatacggagcacaacccgactggagaatgttatgtggaagcagatcactaacgaattgaattatgtgctctgggagggcggtcacgatctgacagtagtcgccggggacgtgaaaggagtgttaaccaagggcaagagagtcctgactcctcccgttaacgatctaaaatactcctggaagacctggggtaaagcaaagatttttacaccagaagccagaaattctacgttcctcatcgacggccccgatacctcggagtgccctaacgaacgccgggcttggaatttctttgaggtggaggactacgggttcggaatgtttactacaaacatttggatgaaattcagagaaggcagctccgaggtatgtgatcataggctgatgtcagccgcaatcaaggaccagaaagctgtgcacgccgatatggggtattggatagaaagttctaagaatcaaacctggcagatcgagaaggcgagccttattgaagtcaaaacatgcttgtggccaaagactcataccctgtggtccaacggagtgctcgagtcacagatgctgatcccgcgcagctacgccggccccttttctcagcacaactatcgacaaggttacgctacgcagacagcagggccttggcacttaggaaaactggagattgacttcggcgaatgcccaggtaccactgttaagatccaggaggattgtgaccatcggggcccctcccttcgtaccacaactgccagtgggaaattggtgacccagtggtgctgtagaagctgcacaatgcctccactcaggtttctgggagaagatggctgttggtatgggatggagatacgccccctatctgagaaggaagagaatatggtcaagtcccaagtgacggctggacagggcacctcagaaactttcagtatgggtctgctctgcctgacactttttgttgaggaatgtttgcggagaagggtgacccgaaaacacatgattctggtcgtagtgatcactttctgcgccattatcttagggggactcacatggatggacctgcttcgcgcactgataatgttgggcgacaccatgagcggccggatcgggggacagattcatctcgcgatcatgacggtttttaagatgtcgccgggttacgtgctgggcgtcttcctaagaaaactgacttccagggagaccgccctcatggtgattgggatggctatgacaaccgtattttctatccctcacgatctgatggagcttatagacggaattagcttgggcctgatcttactcaagatcgtgactcatttcgataacacacaggtcggtaccctggccctttcactgacattcattcgtagtactacgcccctagttatggcatggcgcaccatcatggctgtgtttttcgtgattacactcatacccctgtgtcggacctcctgcttgcaaaaacagtctcactgggtcgaaatcactgccctgattttaggggcacaggccctccctgtgtatctgatgacccttatgaagggagctagcagaaggtcctggcccctgaatgagggcatcatggcggttggcttggtatcactcctggggagcgccctactgaagaacgacgtgccacttgcaggacctatggtcgctggtggcctcctgttggccgcctacgtgatgagtgggtcttccgctgatctgagcttagaaaaagcagccaatgttcaatgggacgagatggcggatattacaggatcgtcacccatcatagaagtgaagcaggacgaggatggctcttttagtatccgagacgtcgaggaaactaacatgattaccctcctggtgaaacttgctctgatcacggtatccggtttgtacccactcgccattccggtcacaatggcactgtggtatatctggcaagtgaagacccagcggagcggggccctatgggatgttccttctcccgctgcaactcaaaaagccacactgagcgagggagtgtaccgcataatgcagagaggccttttcggcaagacccaggtcggggtgggcattcacatggaaggtgtttttcatactatgtggcacgtgacaaggggctccgtcatctgtcatgagaccgggcggctcgaaccatcatgggcggacgtgcgaaatgatatgatcagttatggaggcggttggagactgggggacaagtgggacaaagaggaggatgtacaggtgttggctattgaacccggaaagaaccctcgccacgttcaaacgaaaccaggcttattcaagactctgaccggcgagataggggccgtcacactcgactttaaacccggaaccagcggttctcctatcattaataagaaaggcaaggtgatcgggctgtacggaaacggcgtggtcacaaagtccggtgattatgtatcagcaattactcaggccgaaaggatcggggagccggactacgaggtggatgaagacatattccgtaaaaagcggcttaccatcatggatctgcatccaggagctggcaaaacgaagagaattttgcccagtatcgttagggaggccctaaaacgccgactgagaacactcattctggcacctactcgggtggtcgctgccgaaatggaggaagcgcttaggggcttaccaatccgctatcagacccccgccgtaaagagcgagcacacagggcgtgagatagttgacctgatgtgccacgcaacctttactaccagactcttgtcctctacacgggtgcctaattacaacctgattgtcatggatgaagctcatttcacggacccgtgctcggtggccgctaggggatacatcagcactcgcgtagagatgggtgaagcagccgccatctttatgaccgctacacccccaggctcaattgatcctttcccccagtccaatagtccaatcgaggacatagaacgagagattcctgagagatcttggaacaccgggttcgactggatcactgattatcaaggaaagacagtgtggtttgttcccagcattaaagcgggcaatgacatcgcaaactgtctccggaagtccggtaaaagggtcatacagctgtcacgcaagaccttcgatacggaatacccaaaaactaaacttacagactgggattttgtggtgaccaccgacatttctgagatgggggccaacttcagagctggcagggtcatcgatccgcggcgttgcctgaagcctgttatcttgactgacggacccgaacgcgtgattctagccggcccaatccccgtaacccctgcaagcgccgctcagcgaagagggaggattggacggaatccagcgcaagaggatgaccagtatgtgtttagtggtgatcccctgaaaaacgacgaagatcacgcccattggaccgaggcaaagatgctcttagacaatatatacacacctgagggcatcattccgactctgttcgggccagaacgcgagaaaacgcaggctatcgacggagaatttagacttaggggcgagcagcggaagaccttcgtcgagctgatgcgaagaggtgatctccccgtgtggttgtcctataaagttgccagcgcagggatctcttacaaggaccgcgaatggtgttttacaggcgagaggaacaatcaaattctggaagagaacatggaagtggagatatggactcgggagggagaaaagaaaaagctccgtcctaaatggctggatgccagagtctatgctgaccccatggcccttaaggatttcaaagagtttgcgtcaggcaggaagtccaccacactagacatcctgaccgaaattgcaactttgccaacgtacttaagtagcaaggccaaactggctctcgataatatcgtaatgctgcacaccacagagaaagggggacgcgcctaccagcacgctcttaacgaactgcctgagtcgctcgagactttgatgctggtggcactactgggtgccatgaccgctggcattttcctctttttcatgcaggggaaaggaatcggcaaactttctatgggtctgatagccatcgcagttgcgtccgggttattgtgggtggccgaaattcagccccaatggatcgctgccagcattatcctggagttctttctcatggtcctgcttataccagaacctgagaaacagcggacaccgcaggacaatcagctgatttatgtgatcctcaccattttgactatcataggcctgatcgcagctaacgaaatgggattaattgagaagacaaaaacggatttcggcttttaccaagtcaagaccgagactacaatcctagacgtggatctgcgacccgcctcagcatggaccctctatgccgttgctaccacaattcttactccaatgctgagacatacgatcgaaaataccagtgcgaacttgtctctggccgcaatagctaatcaggccgccgtgctcatggggctgggaaagggctggcctcttcacaggatggacctcggtgtacccctgttggcaatggggtgctactcccaggtgaacccaacaactctgaccgctagcttagtcatgctactgattcattatgccatcatcggacctggcctccaggcgaaagctacacgcgaggcccaaaagcggaccgcagccggtattatgaaaaatcccactgttgatggcatcacggtgatagaccttgaaccgatttcatacgacccaaagttcgagaaacagctggggcaggtcatgttgctggtgctctgtgtaggacaactgcttttaatgagaacaacctgggctctgtgcgaggtgctcactttggcaaccggccctatcatgacactgtgggaagggaaccccggacgtttttggaacactaccattgccgttagtacagcgaatatcttcaggggcagctatctagctggtgccgggctggcattttccctcataaagaacgcccagacgccacggcgcggaaccggcactacaggtgagacccttggcgaaaagtggaaacgacagctgaactctttggatagaaaggagttcgaagagtacaaaaggagcgggatcctggaggtggaccggactgaagctaagtccgccctccgcgatggatcaaaaattaagcacgcagtctctagaggcagttcgaagatcaggtggattgtggagcgagggatgatcaaacccaagggaaaagtcgtggacctgggctgtggtagagggggatggagctactatatggctacattaaagaatgttaccgaagtaaaaggctacacgaagggcgggcctggacatgaggaaccgattcccatggccacctatggttggaatcttgtgaagctgcactccggcgtcgatgtgttttacaaaccaacagagcaggttgacactctcctatgcgatatcggggagtcttcaagcaaccctaccatagaagagggacgtacactgagaattttgaagatggtggaaccctggctgtccagtaaacctgagttctgtatcaaggtcctcaatccatatatgcccactgtgatcgaagaacttgagaaactgcaacgcaggcacggcggttctttggtacggtgccctctgagcagaaactcaacccatgaaatgtactgggtgtccggggcgagtggaaatattgttagctctgtcaacacaatatccaagatgctcttaaatcgctttaccactaggcaccgaaaaccaacgtatgagaaggacgtggatctgggcgccggcacacggtcagtgagcaccgaaactgagaagcccgacatgaccatcattgggagaaggcttcagcgcctgcaggaggaacataaagagacatggcactacgatcaggaaaacccgtaccgtacgtgggcatatcacggatcgtacgaggctccttctaccggtagtgcctccagcatggtcaatggcgttgtgaagctactcactaaaccatgggacgtaatccccatggtgacacaactggcaatgaccgacactacacctttcgggcagcagcgggtctttaaggaaaaagtggataccagaacaccacagcccaagttgggaactaggatgattatgaccacgaccgctaactggctgtgggccctccttggcaagaaaaagtcaccgcgcctgtgtacacgagaggagttcatctccaaagttcggtctaatgccgcgataggtgctgtgttccaagaggaacaggggtggactagcgcaagtgaagccgtcaacgactccagattttgggagttagtggataaggaaagggctctgcatcaggagggaaaatgcgagagctgcgtatataatatgatgggcaagcgcgaaaagaaattgggcgagttcgggagagccaagggatctcgggcaatctggtacatgtggctcggtgccaggtttctggagttcgaggctctaggctttcttaacgaagaccactggttctcacgtgagaacagttggtccggggttgagggagaaggcctgcatcgactcggttatattctggaggatatcgacaaaaaggatggggacttgatttacgcggatgacaccgccggatgggatacacgcatcactgaagacgatctgctcaatgaggagcttataaccgaacaaatggcacctcaccataaaacgctggctaaggccatttttaagttaacatatcagaacaaagtggtcaaggtgctgagacccaccccaaaaggcgcagtgatggacatcatcagccggaaggaccagaggggctctgggcaggtcggaacttacggtttgaatacattcaccaacatggaggttcaactcattcgccagatggaagccgagggcgtgataactcaggatgacatgcagaatcctaaagggctgaaggaaagagtagagaaatggctaaaggagtgtggagtggatcggcttaagaggatggctatctcgggcgacgattgcgtcgtgaaacccctggacgaacgattttcaaccagcctcctgttcttgaacgatatgggtaaggttcgtaaagacgtgccacaatgggagccctccaaggggtggaaaaattggcaggaagtccctttttgtagtcaccacttccataagatttttatgaaggatggaagatctttagtggtaccatgccgcaaccaggacgagctgatcggccgggccaggattagccagggcgcggggtggtccctcagagaaacagcatgtcttggaaaagcctacgctcaaatgtggtcactgatgtatttccaccgccgggatctaaggctggccagtatggcaatctgctctgctgttccgacggagtggttccccaccagccgaactacatggtccatacatgcccagcaccagtggatgaccactgaggacatgctcaaggtgtggaatagagtctggatcgaagacaaccctaatatgacagataaaaccccagtgcactcatgggaggacattccctacttgggtaagcgggaagatctgtggtgtggcagccttatcgggctgtcttccagggctacgtgggccaaaaacattcatacagcaatcacccaggttcgcaatctcattggaaaggaggaatatgtggactacatgcctgtcatgaagcgttatagtgcgccaagcgagtcggagggcgtgttatga

SEQ ID NO: 15764 - RNA, 9867 nt, synthetic construct
  misc_feature 1..9867: note = derived and/or modified CDS sequence (opt3) from DENV-4__JQ915087__SS-prME
  source 1..9867: mol_type = other RNA
agcaccatgaccctgctctgccttatccccactgtgatggcattccacctgtccacgagggacggcgagcctttgatgattgtcgctaagcatgaaagggggcggccattactgtttaagaccacagaggggataaacaagtgtactctaatcgcaatggatctcggtgaaatgtgcgaggacaccgttacatacaaatgtccgctgcttgtgaataccgaacccgaggatattgactgctggtgtaacctgacttctacatgggtaatgtatggaacctgcacgcagtcaggggagcgccgacgtgaaaagcggagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggcttacatgattggccagactggcatccagagaatagtgttctttgttttaatgatgctggtggcaccctcatatgggatgaggtgtgtcggagtgggtaaccgggatttcgttgaaggcgttagcgggggagcctgggtggaccttgtcttggagcacggcggttgcgtgaccacaatggctcaggggaagcctaccctggattttgaactaacgaagactacagccaaagaggtggcgctcctgcgcacctactgtatcgaagcaagtatttccaatatcactacagccacccgatgcccaacgcaaggagagccctatcttaaggaggaacaggaccagcagtacatttgtagaagggatgtcgttgaccggggctggggcaacgggtgcggactgttcggtaaaggcggggtggtaacctgcgctaagtttttgtgttctggaaaaatcacaggcaatctcgtgcaaatagagaacctggaatatactgtcgtggttaccgtgcataatggtgatacacacgccgtcgggaacgacactagcaatcacggcgtgaccgcaacaattacccctcgttccccatcagtagaggttaagttaccggattacggagaactgactctcgactgcgagccccgcagtggcatcgacttcaacgagatgattcttatgaagatgaaaaagaaaacgtggctggtgcataagcagtggtttttggatctacctctgccatggacagctggggccgacaccagcgaagtccactggaattacaaagagagaatggtgactttcaaggtcccccatgcgaaaaggcaggatgtgaccgttctcggatctcaggaaggtgccatgcactccgcactggctggcgccacagaggtggactcaggggatggaaaccacatgtttgctggccatcttaagtgtaaggtacggatggaaaaactgcgaatcaagggtatgagctataccatgtgcagtgggaaattctctatcgacaaggagatggccgagactcaacacggcacaacggtcgtgaaagttaagtacgaaggagcaggcgccccttgtaagattccaatagagatccgcgatgtgaataaagaaaaggtcgtggggagaattatctccagcacccccttcgctgagaacactaactcggtaataaatattgagttggaaccgccttttggagactcttatatcgtgatcggtgttggcgattccgcgctcacactgcattggttcaggaaagggtcaagtattggaaagatgtttgagagcacctaccggggcgcaaaacgcatggccatcttaggtgaaacagcttgggacttcgggtccgtcggcggactgtttacttctctaggcaaggccgtgcaccaggtgttcgggagcgtctataccacgatgtttggaggcgtttcatggatgattagaatactcatcggtttcctggtgctttggattgggaccaacagtaggaatacatccatggcaatgacttgcatcgccgtgggaggcatcaccttgtttctgggtttcacagtacaggctgatatgggctgtgtcgtgagctggaacgggaaggagctcaaatgcggatctggcatttttgttgtggacaatgtccatacttggaccgaacaatacaagttccagcccgagtcaccagcccgtctggcaagtgcgatacttaacgctcacaaagacggggtgtgtggaatccggagcacgacacgactggagaatgttatgtggaagcagattaccaacgaattgaattatgtgctctgggagggcggtcacgatctgactgtagtcgccggggacgtgaaaggagtgttaacaaagggcaagagagcactgacccctcccgtcaacgatctaaaatactcctggaagacttggggtaaagccaagatctttaccccagaagctagaaattctacattcctcattgacggccccgatacgtcggagtgccctaacgaacgccgggcctggaatttctttgaggttgaggactacgggttcggaatgtttaccactaacatctggatgaaattcagagaaggcagctccgaggtgtgtgatcataggctgatgtcagcagctataaaggaccagaaagccgtacacgcggatatggggtattggatcgaaagttctaagaatcaaacatggcagattgagaaggccagccttatcgaagtgaaaacctgcttgtggccaaagacacatactctgtggtccaacggagtcctcgagtcacagatgctgattccgcgcagctacgctggccccttttctcagcacaactatcgacaaggttacgcaacccagacggccgggccttggcacttaggaaaactggagatcgacttcggcgaatgcccaggtacaaccgtgaagatacaggaggattgtgaccatcggggcccctcccttcgtactaccacagctagtgggaaattggttactcagtggtgctgtagaagctgcaccatgcctccactcaggtttctgggagaagatggctgttggtatgggatggagattcgccccctatctgagaaggaagagaatatggtgaagtcccaagtcacagccggacagggcacgtcagaaaccttcagtatgggtctgctctgcctgactctttttgtggaggaatgtttgcggagaagggttacacgaaaacacatgatcctggtggtcgtaattaccttctgcgcaatcatattagggggactcacttggatggacctgcttcgcgcgctgatcatgttgggcgacacaatgagcggccggattgggggacagatccatctcgccattatgaccgtgtttaagatgtcgccgggttacgttctgggcgtgttcctaagaaaactgacgtccagggagactgctctcatggtcatcgggatggccatgaccacagtgttttctatacctcacgatctgatggagcttattgacggaatcagcttgggcctgatcttactcaagattgtaacccatttcgataacactcaggtgggtacactggcactttcactgaccttcatccgtagtacaactcccctagtcatggcttggcgcaccattatggccgtatttttcgtgataacgctcatccccctgtgtcggacatcctgcttgcaaaaacagtctcactgggtggaaattaccgcactgatcttaggggcccaggctctccctgtctatctgatgactcttatgaagggagcgagcagaaggtcctggcccctgaatgagggcattatggccgtgggcttggtttcactcctggggagcgcactactgaagaacgacgtaccacttgctggacctatggtggccggtggcctcctgttggccgcttacgtcatgagtgggtcttccgcagatctgagcttagaaaaagccgcgaatgtgcaatgggacgagatggctgatatcaccggatcgtcacccataatcgaagttaagcaggacgaggatggctcttttagtattcgagacgtggaggaaacaaacatgatcactctcctggtcaaacttgccctgattaccgtgtccggtttgtacccactcgcaatcccggtaacgatggccctgtggtatatatggcaggtcaagacacagcggagcggggctctatgggatgtgccttctcccgcagccacccaaaaagcgactctgagcgagggagtttaccgcattatgcagagaggccttttcggcaagacacaggtgggggtcggaatccacatggaaggtgtgtttcataccatgtggcacgttactaggggctccgtgatctgtcatgagacagggcggctcgaaccatcatgggctgacgtccgaaatgatatgattagttatggaggcggttggagactgggggacaagtgggacaaagaggaggatgtgcaggtattggccatagaacccggaaagaaccctcgccacgtgcaaaccaaaccaggcttattcaagacgctgactggcgagatcggggcagttaccctcgactttaaacccggaacaagcggttctcctattatcaataagaaaggcaaggtcattgggctgtacggaaacggcgtggtgaccaagtccggtgattatgtctcagccatcacacaggctgaaaggataggggagccggactacgaggtagatgaagacatcttccgtaaaaagcggcttactattatggatctgcatccaggagccggcaaaaccaagagaatcttgcccagtattgtgagggaggcactaaaacgccgactgagaacgctcatcctggctcctacacgggttgtggccgcggaaatggaggaagcccttaggggcttaccaatacgctatcagactcccgcagtcaagagcgagcacaccgggcgtgagattgtggacctgatgtgccacgctacatttaccactagactcttgtcctctacccgggttcctaattacaacctgatcgtgatggatgaagcccatttcacagacccgtgctcggtcgctgcaaggggatacatcagcacgcgcgtggagatgggtgaagccgccgctatttttatgactgcgacaccaccaggctcaatcgatcctttcccccagtccaatagtccaatagaggacattgaacgagagatccctgagagatcttggaacacagggttcgactggattaccgattatcaaggaaagactgtatggtttgtgcccagcatcaaagcaggcaatgacatagccaactgtctccggaagtccggtaaaagggttattcagctgtcacgcaagacattcgataccgaatacccaaaaacgaaacttactgactgggattttgtcgtgacaaccgacatctctgagatgggggctaacttcagagccggcagggtgatcgatccgcggcgttgcctgaagcctgtcattttgaccgacggacccgaacgcgttatcctagcaggcccaattcccgtgactcctgccagcgctgcgcagcgaagagggaggataggacggaatccagcccaagaggatgaccagtatgtatttagtggtgatcccctgaaaaacgacgaagatcacgcacattggacagaggctaagatgctcttagacaatatctacacccctgagggcattatcccgacactgttcgggccagaacgcgagaaaactcaggccatcgacggagaatttagacttaggggcgagcagcggaagacgttcgtggagctgatgcgaagaggtgatctccccgtctggttgtcctataaagtggcaagcgccgggatttcttacaaggaccgcgaatggtgttttaccggcgagaggaacaatcaaatactggaagagaacatggaagttgagatctggacacgggagggagaaaagaaaaagctccgtcctaaatggctggatgctagagtgtatgccgaccccatggcgcttaaggatttcaaagagtttgcatcaggcaggaagtccactaccctagacattctgacagaaatcgccaccttgccaacttacttaagtagcaaggctaaactggccctcgataatattgtcatgctgcacacgaccgagaaagggggccgcgcttaccagcacgcacttaacgaactgcctgagtcgctcgagacattgatgctggtagccctactgggtgctatgactgccggcatcttcctctttttcatgcaggggaaaggaataggcaaactttctatgggtctgatcgcaattgcggtggcctccgggttattgtgggttgctgaaatccagccccaatggattgccgcaagcatcatactggagttctttctcatggtgctgcttattccagaacctgagaaacagcggaccccgcaggacaatcagctgatctatgtcattctcacaatcttgaccataatcggcctgattgctgccaacgaaatgggattaatcgagaagactaaaacagatttcggcttttaccaagtgaagacggagaccactattctagacgtcgatctgcgacccgcatcagcctggacactctatgctgtggcgaccaccatccttacaccaatgctgagacatactatagaaaatacgagtgccaacttgtctctggcagctattgccaatcaggccgcagttctcatggggctgggaaagggctggcctcttcacaggatggacctcggtgtgcccctgttggctatggggtgctactcccaggtaaacccaaccacactgactgccagcttagtgatgctactgatccattatgcgatcattggacctggcctccaggctaaagccacccgcgaggcacaaaagcggacagccgctggtatcatgaaaaatcccaccgtcgatggcataactgttattgaccttgaaccgatctcatacgacccaaagttcgagaaacagctgggacaggtgatgttgctggtcctctgtgtgggacaactgcttttaatgagaacgacatgggcactgtgcgaggtactcaccttggccactggccctattatgaccctgtgggaagggaaccccggacgtttttggaacacaactatcgcggtgagtaccgctaatatattcaggggcagctatctagccggtgcagggctggccttttccctcatcaagaacgctcagacaccacggcgcggaacgggcaccactggtgagacacttggcgaaaagtggaaacgacagctgaactctttggatagaaaggagttcgaagagtacaaaaggagcgggattctggaggttgaccggaccgaagccaagtccgcactccgcgatggatcaaaaatcaagcacgctgtgtctagaggcagttcgaagattaggtggatcgtcgagcgagggatgattaaacccaagggaaaagtggtcgacctgggctgtggtagaggcgggtggagctactatatggccactttaaagaatgtgacagaagttaaagggtacaccaagggcgggcctggacatgaggaaccgatccccatggcgacgtatggttggaatcttgtaaagctgcactccggcgtggatgtcttttacaaaccaaccgaacaggtggacacactcctatgcgatataggggagtcttcaagcaaccctactattgaagagggacgtaccctgagaatcttgaagatggttgaaccctggctgtccagtaaacctgagttctgtatcaaggtgctcaatccatatatgcccacagtcattgaggaacttgagaaactgcaacgcaggcacggcggttctttggtgcggtgccctctgagcagaaactcaactcatgaaatgtactgggtatccggggccagtggaaatatagtgagctctgttaacaccatctccaagatgctcttaaatcgctttacaaccaggcaccgaaaaccaacttatgagaaggacgtcgatctgggcgcaggcacgcggtcagtgagcacagaaaccgagaagcccgacatgactattatcgggagaaggcttcagcgcctgcaggaggaacataaagagacctggcactacgatcaggaaaacccgtaccgtacatgggcttatcacggatcgtacgaggccccttctacgggtagtgcatccagcatggtgaatggcgtcgttaagctactcaccaaaccatgggacgtgattcccatggtaactcaactggctatgacagacaccactcctttcgggcagcagcgggtgtttaaggaaaaagtcgatacaagaaccccacagcccaagttgggaacaaggatgatcatgactaccacggccaactggctgtgggccctccttggcaagaaaaagtcaccgcgcctgtgtacccgagaggagttcatatccaaagtgcggtctaatgcggctatcggtgcagttttccaagaggaacaggggtggacaagcgccagtgaagctgtgaacgactccagattttgggagttagtcgataaggaaagggccctgcatcaggagggaaaatgcgagagctgcgtgtataatatgatgggcaagcgcgaaaagaaattgggcgagttcgggagagcaaagggatctcgggccatttggtacatgtggctcggtgctaggtttctggagttcgaggcgctaggctttcttaacgaagaccactggttctcacgtgagaacagttggtccggggtagagggagaaggcctgcatagcctcggttatatcctggaggatattgacaaaaaggatggggacttgatctacgccgatgacactgcaggatgggatacccgaataacagaagacgatctgctcaatgaggagcttattactgaacaaatggctcctcaccataaaaccctggccaaggcaatctttaagttaacgtatcagaacaaagttgtgaaggtcctgcgccccacaccaaaaggcgccgtgatggacatcatttctagaaaggaccagcggggctcgggacaggtgggaacctacggtttgaatactttcacaaacatggaggtccaactcataaggcagatggaagctgagggcgttatcacccaggatgacatgcagaatcctaaagggctgaaggaacgcgtggagaaatggctaaaggagtgtggagtagatagacttaagcggatggccatttcaggcgacgattgcgtggtcaaacccctggacgaaaggtttagcacttccctcctgttcttgaacgatatgggtaaggtgcgaaaagacgttccacaatgggagcccagtaaggggtggaaaaattggcaggaagtgcctttttgttctcaccacttccataagatctttatgaaggatggacgtagcttagtcgtgccatgcagaaaccaggacgagctgattggccgcgcgcggatctcccagggcgcagggtggtcactcagggaaaccgcctgtcttggaaaggcttacgcccaaatgtggagtctgatgtatttccacagacgcgatctacggctggcatctatggctatatgcagcgccgtaccgacagagtggttccccacgtccaggaccacttggtcaatccatgctcagcaccagtggatgacaaccgaggacatgctcaaggtttggaatcgagtgtggattgaagacaaccctaatatgactgataaaacaccagtccacagctgggaggacatcccctacttgggtaagagagaagatctgtggtgtggctctcttattgggctgtccagtcgggccacctgggccaagaacatccatacggcgattacacaggtgaggaatctcataggaaaggaggaatatgttgactacatgcctgtgatgaagcgctatagcgccccatcggagtccgagggcgtcttatga

SEQ ID NO: 15765 - RNA, 9867 nt, synthetic construct
  misc_feature 1..9867: note = derived and/or modified CDS sequence (opt3) from DENV-4__JQ915089__SS-prME
  source 1..9867: mol_type = other RNA
agcaccatgacactgctctgccttatcccaactgtgatggccttccacctgtccacgagagacggcgagcctttgatgattgtcgctaagcatgaaagggggcggccattactgtttaagaccacagaggggataaacaagtgtactctaatcgcaatggatctcggtgaaatgtgcgaggacaccgttacatacaagtgtccgctgcttgtgaataccgaacccgaggatattgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaagcatgcccagcgggtcgagtcgtggatcctgcgcaatccagggttcgcactgctcgccggatttatggcttacatgattggccagactggcatccagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagtatctccaatattacaaccgccacgcgatgcccaacccaaggagagccctatcttaaggaggaacaggaccagcagtacatctgtagaagggatgtcgttgaccggggctggggcaacgggtgcggactgttcggtaaaggcggggtggtaacatgcgctaagtttttgtgttctggaaaaattactggcaatctcgtgcaaatcgagaacctggaatataccgtcgtggttacagtgcataatggtgatactcacgccgtcgggaacgacaccagcaatcacggcgtgacagcaaccataactcctcgttccccatcagtagaggttaagttaccggattacggagaactgacgctcgactgcgagccccgcagtggcattgacttcaacgagatgatccttatgaagatgaaaaagaaaacatggctggtgcataagcagtggtttttggatctacctctgccatggaccgctggggccgacactagcgaagtccactggaattacaaagagagaatggtgaccttcaaggtcccccatgcgaaaaggcaggatgtgacagttctcggatctcaggaaggtgccatgcactccgcactggctggcgccaccgaggtggactcaggggatggaaaccacatgtttgctggccatcttaagtgtaaggtacggatggaaaaactgcgaattaagggtatgagctatactatgtgcagtgggaaattctctatcgacaaggagatggccgagacacaacacggcacgaccgtcgtgaaagttaagtacgaaggagcaggcgccccttgtaagatcccaattgagatacgcgatgtgaataaagaaaaggtcgtggggagaatcatttccagcactcccttcgctgagaacacaaactcggtaatcaatatagagttggaaccgccttttggagactcttatattgtgatcggtgttggcgattccgcgctcaccctgcattggttcaggaaagggtcaagtatcggaaagatgtttgagagcacataccggggcgcaaaacgcatggccattttaggtgaaactgcttgggacttcgggtccgtcggcggactgtttacctctctaggcaaggccgtgcaccaggtgttcgggagcgtctatacgaccatgtttggaggcgtttcatggatgatcaggattctcataggtttcctggtgctttggatcgggacaaacagtaggaatacttccatggcaatgacctgcattgccgtgggaggcatcacattgtttctgggtttcactgtacaggctgatatgggctgtgtcgtgagctggaacgggaaggagctcaaatgcggatctggcatctttgttgtggacaatgtccatacctggacggaacaatacaagttccagcccgagtcaccagcccgtctggcaagtgcgattcttaacgctcacaaagacggggtgtgtggaatacggagcacaacccgactggagaatgttatgtggaagcagatcactaacgaattgaattatgtgctctgggagggcggtcacgatctgacagtagtcgccggggacgtgaaaggagtgttaaccaagggcaagagagtcctgactcctcccgttaacgatctaaaatactcctggaagacctggggtaaagcaaagatttttacaccagaagccagaaattctacgttcctcatcgacggccccgatacctcggagtgccctaacgaacgccgggcttggaatttctttgaggtggaggactacgggttcggaatgtttactacaaacatttggatgaaattcagagaaggcagctccgaggtatgtgatcataggctgatgtcagccgcaatcaaggaccagaaagctgtgcacgccgatatggggtattggatagaaagttctaagaatcaaacctggcagatcgagaaggcgagccttattgaagtcaaaacatgcttgtggccaaagactcataccctgtggtccaacggagtgctcgagtcacagatgctgatcccgcgcagctacgccggccccttttctcagcacaactatcgacaaggttacgctacgcagacagcagggccttggcacttaggaaaactggagattgacttcggcgaatgcccaggtaccactgttaagatccaggaggattgtgaccatcggggcccctcccttcgtaccacaactgccagtgggaaattggtgacccagtggtgctgtagaagctgcacaatgcctccactcaggtttctgggagaagatggctgttggtatgggatggagatacgccccctatctgagaaggaagagaatatggtcaagtcccaagtgacggctggacagggcacctcagaaactttcagtatgggtctgctctgcctgacactttttgttgaggaatgtttgcggagaagggtgacccgaaaacacatgattctggtcgtagtgatcactttctgcgccattatcttagggggactcacatggatggacctgcttcgcgcactgataatgttgggcgacaccatgagcggccggatcgggggacagattcatctcgcgatcatgacggtttttaagatgtcgccgggttacgtgctgggcgtcttcctaagaaaactgacttccagggagaccgccctcatggtgattgggatggctatgacaaccgtattttctatccctcacgatctgatggagcttatagacggaattagcttgggcctgatcttactcaagatcgtgactcatttcgataacacacaggtcggtaccctggccctttcactgacattcattcgtagtactacgcccctagttatggcatggcgcaccatcatggctgtgtttttcgtgattacactcatacccctgtgtcggacctcctgcttgcaaaaacagtctcactgggtcgaaatcactgccctgattttaggggcacaggccctccctgtgtatctgatgacccttatgaagggagctagctccagatcatggcccctgaatgagggcatcatggcggttggcttggtaagcctcctggggagtgccctactgaagaacgacgtgccacttgcaggacctatggtcgctggtggcctcctgttggccgcctacgtgatgtctgggtccagcgctgatctgtcgttagaaaaagcagccaatgttcaatgggacgagatggcggatattacaggatcatctcccatcatagaagtgaagcaggacgaggatggcagtttttccatcagggacgtcgaggaaactaacatgattaccctcctggtgaaacttgctctgatcacggtaagcggtttgtacccactcgccattccggtcacaatggcactgtggtatatctggcaagtgaagacccagcgatctggggccctatgggatgttcctagccccgctgcaactcaaaaagccacactgtccgagggagtgtaccggataatgcagcgcggccttttcggcaagacccaggtcggggtgggcattcacatggaaggtgtttttcatactatgtggcacgtgacaagaggctcagtcatctgtcatgagaccgggaggctcgaaccaagttgggcggacgtgcggaatgatatgatcagctatggaggcggttggcgactgggggacaagtgggacaaagaggaggatgtacaggtgttggctattgaacccggaaagaaccctagacacgttcaaacgaaaccaggcttattcaagactctgaccggcgagataggggccgtcacactcgactttaaacccggaacctctggttcccctatcattaataagaaaggcaaggtgatcgggctgtacggaaacggcgtggtcacaaagtcaggtgattatgtaagtgcaattactcaggccgaacgcatcggggagccggactacgagatagatgaagacatcttcaggaaaaagcgtcttaccattatggatctgcatccaggagctggcaaaacgaagcggatcttgcccagcattgtgagagaggccctaaaaaggcgcctgcgaacactcatcctggcacctactagagttgtggctgccgaaatggaggaagcgcttcggggcttaccaataaggtatcagacccccgccgtcaagtccgagcacacagggcgcgagattgtggacctgatgtgccacgcaacctttactacccgtctcttgtcttcgacaagagttcctaattacaacctgatcgtgatggatgaagctcatttcacggacccgtgcagcgtcgccgctcggggatacatctcaactagggtggagatgggtgaagcagccgccatttttatgaccgctacacccccaggctccatcgatcctttcccccagagtaattctccaatagaggacattgaacgcgagatccctgagcgaagctggaacaccgggttcgactggattactgattatcaaggaaagacagtatggtttgtgccctccatcaaagcgggcaatgacatagcaaactgtctcagaaagtcaggtaaacgggttattcagctgtctaggaagaccttcgatacggaatacccaaaaactaaacttacagactgggattttgtcgtgaccaccgacatcagcgagatgggggccaacttccgcgctggcagagtgatcgatccgaggcggtgcctgaagcctgtcattttgactgacggacccgaacgtgttatcctagccggcccaattcccgtgactcctgcaagtgccgctcagcgccgagggagaataggaaggaatccagcgcaagaggatgaccagtatgtattttccggtgatcccctgaaaaacgacgaagatcacgcccattggaccgaggcaaagatgctcttagacaatatctacacacctgagggcattatcccgactctgttcgggccagaacgggagaaaacgcaggctatcgacggagaatttcgccttagaggcgagcagaggaagaccttcgtggagctgatgcggcgaggtgatctccccgtctggttgagctataaagtggcctctgcagggatttcatacaaggacagagaatggtgttttacaggcgagcgcaacaatcaaatactggaagagaacatggaagttgagatctggactagggagggagaaaagaaaaagctccggcctaaatggctggatgcccgtgtgtatgctgaccccatggcccttaaggatttcaaagagtttgcgtccggcagaaagagtaccacactagacattctgaccgaaatcgcaactttgccaacgtacttaagctcgaaggccaaactggctctcgataatattgtcatgctgcacaccacagagaaaggtgggagggcctaccagcacgctcttaacgaactgcctgagtctctcgagactttgatgctggtagcactactgggggccatgaccgctggcatcttcctctttttcatgcaggggaaaggaataggcaaactttccatgggtctgatcgccattgcagtggcgagcgggttattgtgggttgccgaaatccagccccaatggattgctgcctcaatcatactggagttctttctcatggtgctgcttattccagaacctgagaaacagcgcacaccgcaggacaatcagctgatctatgtcattctcaccatcttgactataatcggcctgattgcagctaacgaaatgggattaatcgagaagacaaaaacggatttcggcttttaccaagtgaagaccgagactacaattctagacgtcgatctgcggcccgccagtgcatggaccctctatgccgtggctaccacaatccttactccaatgctgcgacatacgatagaaaatacctctgcgaacttgtccctggccgcaattgctaatcaggccgccgttctcatggggctgggaaagggctggcctcttcacagaatggacctcggtgtgcccctgttggcaatggggtgctacagccaggtaaacccaacaactctgaccgcttcattagtgatgctactgatccattatgccatcattggacctggcctccaggcgaaagctacaagggaggcccaaaagcgcaccgcagccggtatcatgaaaaatcccactgtcgatggcataacggttattgaccttgaaccgatcagttacgacccaaagttcgagaaacagctgggacaggtgatgttgctggtcctctgtgtgggacaactgcttttaatgcggacaacctgggctctgtgcgaggtactcactttggcaaccggccctattatgacactgtgggaagggaaccccggaagattttggaacactaccatcgccgtgagcacagcgaatatattccgtggctcctatctagctggtgccgggctggcattttctctcatcaagaacgcccagacgccaaggcggggaaccggcactacaggtgagacccttggcgaaaagtggaaacgccagctgaatagcttggatcgaaaggagttcgaagagtacaaaagatccgggattctggaggttgacaggactgaagctaagtcagccctccgggatggatctaaaatcaagcacgcagtgagtcgcggctcgagcaagattagatggatcgtcgagagggggatgattaaacccaagggaaaagtggtcgacctgggctgtggtcgagggggatggtcctactatatggctacattaaagaacgtgaccgaagttaaaggctacacgaagggcgggcctggacatgaggaaccgatccccatggccacctatggttggaatcttgtaaagctgcactctggcgtggatgtcttttacaaaccaacagaacaggtggacactctcctatgcgatataggggagtcaagctccaaccctaccattgaagagggacggacactgcgtatcttgaagatggttgaaccctggctgagttctaaacctgagttctgtatcaaggtgctcaatccatatatgcccactgtcattgaggaacttgagaaactgcaaagacgccacggcggtagcttggtgaggtgccctctgtcacggaactccacccatgaaatgtactgggtaagtggggcgagcggaaatatagtgtcttccgttaacacaatctcaaagatgctcttaaatagatttaccactcgccacaggaaaccaacgtatgagaaggacgtcgatctgggcgccggcacacgaagcgtgtcgaccgaaactgagaagcccgacatgaccattatcgggcggagacttcagaggctgcaggaggaacataaagagacatggcactacgatcaggaaaacccgtaccgcacgtgggcatatcacggatcttacgaggctcctagtaccggttccgccagctcaatggtgaatggcgtcgttaagctactcactaaaccatgggacgtgattcccatggtaacacaactggcaatgaccgacactacacctttcgggcagcagcgtgtgtttaaggaaaaagtcgatacccggacaccacagcccaagttgggaactagaatgatcatgaccacgaccgctaactggctgtgggccctccttggcaagaaaaagtccccgaggctgtgtacacgcgaggagttcatatctaaagtgcgaagcaatgccgcgatcggtgctgttttccaagaggaacaggggtggacaagtgcatccgaagccgtgaacgacagccggttttgggagttagtcgataaggaaagagctctgcatcaggagggaaaatgcgagtcttgcgtgtataatatgatgggcaagagggaaaagaaattgggcgagttcgggcgcgccaagggatcaagagcaatttggtacatgtggctcggtgcccggtttctggagttcgaggctctaggctttcttaacgaagaccactggttcagtagggagaactcctggagcggggtagagggagaaggcctgcatcgtctcggttatatcctggaggatattgacaaaaaggatggggacttgatctacgcggatgacaccgccggatgggatacacgaataactgaagacgatctgctcaatgaggagcttattaccgaacaaatggcacctcaccataaaacgctggctaaggccatctttaagttaacatatcagaacaaagttgtgaaggtcctgcgccccaccccaaaaggcgcagtgatggacatcatttctagaaaggaccagcggggctcgggacaggtgggaacttacggtttgaatacattcaccaacatggaggtccaactcataaggcagatggaagccgagggcgttatcactcaggatgacatgcagaatcctaaagggctgaaggaacgcgtggagaaatggctaaaggagtgtggagtagatagacttaagcggatggctatttcaggcgacgattgcgtggtcaaacccctggacgaaaggtttagcacctccctcctgttcttgaacgatatgggtaaggtgcgaaaagacgttccacaatgggagcccagtaaggggtggaaaaattggcaggaagtgcctttttgttctcaccacttccataagatctttatgaaggatggacgtagcttagtcgtgccatgcagaaaccaggacgagctgattggccgcgcccggatctcccagggcgcggggtggtcactcagggaaacagcatgtcttggaaaagcctacgctcaaatgtggagtctgatgtatttccacagacgcgatctacggctggcctctatggcaatatgcagcgctgtaccgacggagtggttccccacctccaggactacatggtcaatccatgcccagcaccagtggatgaccactgaggacatgctcaaggtttggaatcgagtgtggattgaagacaaccctaatatgacagataaaaccccagtccacagctgggaggacatcccctacttgggtaagagagaagatctgtggtgtggctctcttattgggctgtccagtcgggctacgtgggccaaaaacatccatacagcaattacccaggtgaggaatctcataggaaaggaggaatatgttgactacatgcctgtgatgaagcgctatagcgcgccatcggagtccgagggcgtcttatga

SEQ ID NO: 15766 - RNA, 9867 nt, synthetic construct
  misc_feature 1..9867: note = derived and/or modified CDS sequence (opt3) from DENV-4__JQ915082__SS-prME
  source 1..9867: mol_type = other RNA
agcaccatgaccctgctctgccttatccccactgtgatggcattccacctgtccacgagggacggcgagcctttgatgattgtcgctaagcatgaaagggggcggccattactgtttaagaccacggaggggataaacaagtgtactctaatcgcaatggatctcggtgaaatgtgcgaggacaccgttacatacaaatgtccgctgcttgtgaataccgaacccgaggatattgactgctggtgtaacctgacttctacatgggtaatgtatggaacctgcacgcagtcaggggagcgccgacgtgaaaagcggagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggcttacatgattggccagactggcatccagagaatagtgttctttgttttaatgatgctggtggcaccctcatatgggatgaggtgtgtcggagtgggtaaccgggatttcgttgaaggcgttagcgggggagcctgggtggaccttgtcttggagcacggcggttgcgtgaccacaatggctcaggggaagcctaccctggattttgaactaacgaagactacagccaaagaggtggcgctcctgcgcacctactgtatcgaagcaagtatttccaatatcactacagccacccgatgcccaacgcaaggagagccctatcttaaggaggaacaggaccagcagtacatttgtagaagggatgtcgttgaccggggctggggcaacgggtgcggactgttcggtaaaggcggggtggtaacctgcgctaagtttttgtgttctggaaaaatcacaggcaatctcgtgcaaatagagaacctggaatatactgtcgtggttaccgtgcataatggtgatacacacgccgtcgggaacgacactagcaatcacggcgtgaccgcaacaattacccctcgttccccatcagtagaggttaagttaccggattacggagaactgactctcgactgcgagccccgcagtggcatcgacttcaacgagatgattcttatgaagatgaaaaagaaaacgtggctggtgcataagcagtggtttttggatctacctctgccatggacagctggggccgacaccagcgaagtccactggaattacaaagagagaatggtgactttcaaggtcccccatgcgaaaaggcaggatgtgaccgttctcggatctcaggaaggtgccatgcactccgcactggctggcgccacagaggtggactcaggggatggaaaccacatgtttgctggccatcttaagtgtaaggtacggatggaaaaactgcgaatcaagggtatgagctataccatgtgcagtgggaaattctctatcgacaaggagatggccgagactcaacacggcacaacggtcgtgaaagttaagtacgaaggagcaggcgccccttgtaagattccaatagagatccgcgatgtgaataaagaaaaggtcgtggggagaattatctccagcacccccttcgctgagaacactaactcggtaataaatattgagttggaaccgccttttggagactcttatatcgtgatcggtgttggcgattccgcgctcacactgcattggttcaggaaagggtcaagtattggaaagatgtttgagagcacctaccggggcgcaaaacgcatggccatcttaggtgaaacagcttgggacttcgggtccgtcggcggactgtttacttctctaggcaaggccgtgcaccaggtgttcgggagcgtctataccacgatgtttggaggcgtttcatggatgattagaatactcatcggtttcctggtgctttggattgggaccaacagtaggaatacatccatggcaatgacttgcatcgccgtgggaggcatcaccttgtttctgggtttcacagtacaggctgatatgggctgtgtcgtgagctggaacgggaaggagctcaaatgcggatctggcatttttgttgtggacaatgtccatacttggaccgaacaatacaagttccagcccgagtcaccagcccgtctggcaagtgcgatacttaacgctcacaaagacggggtgtgtggaatccggagcacgacacgactggagaatgttatgtggaagcagattaccaacgaattgaattatgtgctctgggagggcggtcacgatctgactgtagtcgccggggacgtgaaaggagtgttaacaaagggcaagagagcactgacccctcccgtcaacgatctaaaatactcctggaagacttggggtaaagccaagatctttaccccagaagctagaaattctacattcctcattgacggccccgatacgtcggagtgccctaacgaacgccgggcctggaatttctttgaggttgaggactacgggttcggaatgtttaccactaacatctggatgaaattcagagaaggcagctccgaggtgtgtgatcataggctgatgtcagcagctataaaggaccagaaagccgtacacgcggatatggggtattggatcgaaagttctaagaatcaaacatggcagattgagaaggccagccttatcgaagtgaaaacctgcttgtggccaaagacacatactctgtggtccaacggagtcctcgagtcacagatgctgattccgcgcagctacgctggccccttttctcagcacaactatcgacaaggttacgcaacccagacggccgggccttggcacttaggaaaactggagatcgacttcggcgaatgcccaggtacaaccgtgaagatacaggaggattgtgaccatcggggcccctcccttcgtactaccacagctagtgggaaattggttactcagtggtgctgtagaagctgcaccatgcctccactcaggtttctgggagaagatggctgttggtatgggatggagattcgccccctatctgagaaggaagagaatatggtgaagtcccaagtcacagccggacagggcacgtcagaaaccttcagtatgggtctgctctgcctgactctttttgtggaggaatgtttgcggagaagggttacacgaaaacacatgatcctggtggtcgtaattaccttctgcgcaatcatattagggggactcacttggatggacctgcttcgcgcgctgatcatgttgggcgacacaatgagcggccggattgggggacagatccatctcgccattatgaccgtgtttaagatgtcgccgggttacgttctgggcgtgttcctaagaaaactgacgtccagggagactgctctcatggtcatcgggatggccatgaccacagtgttttctatacctcacgatctgatggagcttattgacggaatcagcttgggcctgatcttactcaagattgtaacccatttcgataacactcaggtgggtacactggcactttcactgaccttcatccgtagtacaactcccctagtcatggcttggcgcaccattatggccgtatttttcgtgataacgctcatccccctgtgtcggacatcctgcttgcaaaaacagtctcactgggtggaaattaccgcactgatcttaggggcccaggctctccctgtctatctgatgactcttatgaagggagcgagcagaaggtcctggcccctgaatgagggcattatggccgtgggcttggtttcactcctggggagcgcactactgaagaacgacgtaccacttgctggacctatggtggccggtggcctcctgttggccgcttacgtcatgagtgggtcttccgcagatctgagcttagaaaaagccgcgaatgtgcaatgggacgagatggctgatatcaccggatcgtcacccataatcgaagttaagcaggacgaggatggctcttttagtattcgagacgtggaggaaacaaacatgatcactctcctggtcaaacttgccctgattaccgtgtccggtttgtacccactcgcaatcccggtaacgatggccctgtggtatatatggcaggtcaagacacagcggagcggggctctatgggatgtgccttctcccgcagccacccaaaaagcgactctgagcgagggagtttaccgcattatgcagagaggccttttcggcaagacacaggtgggggtcggaatccacatggaaggtgtgtttcataccatgtggcacgttactaggggctccgtgatctgtcatgagacagggcggctcgaaccatcatgggctgacgtccgaaatgatatgattagttatggaggcggttggagactgggggacaagtgggacaaagaggaggatgtgcaggtattggccatagaacccggaaagaaccctcgccacgtgcaaaccaaaccaggcttattcaagacgctgactggcgagatcggggcagttaccctcgactttaaacccggaacaagcggttctcctattatcaataagaaaggcaaggtcattgggctgtacggaaacggcgtggtgaccaagtccggtgattatgtctcagccatcacacaggctgaaaggataggggagccggactacgaggtagatgaagacatcttccgtaaaaagcggcttactattatggatctgcatccaggagccggcaaaaccaagagaatcttgcccagtattgtgagggaggcactaaaacgccgactgagaacgctcatcctggctcctacacgggttgtggccgcggaaatggaggaagcccttaggggcttaccaatacgctatcagactcccgcagtcaagagcgagcacaccgggcgtgagattgtggacctgatgtgccacgctacatttaccactagactcttgtcctctacccgggttcctaattacaacctgatcgtgatggatgaagcccatttcacagacccgtgctcggtcgctgcaaggggatacatcagcacgcgcgtggagatgggtgaagccgccgctatttttatgactgcgacaccaccaggctcaatcgatcctttcccccagtccaatagtccaatagaggacattgaacgagagatccctgagagatcttggaacacagggttcgactggattaccgattatcaaggaaagactgtatggtttgtgcccagcatcaaagcaggcaatgacatagccaactgtctccggaagtccggtaaaagggttattcagctgtcacgcaagacattcgataccgaatacccaaaaacgaaacttactgactgggattttgtcgtgacaaccgacatctctgagatgggggctaacttcagagccggcagggtgatcgatccgcggcgttgcctgaagcctgtcattttgaccgacggacccgaacgcgttatcctagcaggcccaattcccgtgactcctgccagcgctgcgcagcgaagagggaggataggacggaatccagcccaagaggatgaccagtatgtatttagtggtgatcccctgaaaaacgacgaagatcacgcacattggacagaggctaagatgctcttagacaatatctacacccctgagggcattatcccgacactgttcgggccagaacgcgagaaaactcaggccatcgacggagaatttagacttaggggcgagcagcggaagacgttcgtggagctgatgcgaagaggtgatctccccgtctggttgtcctataaagtggcaagcgccgggatttcttacaaggaccgcgaatggtgttttaccggcgagaggaacaatcaaatactggaagagaacatggaagttgagatctggacacgggagggagaaaagaaaaagctccgtcctaaatggctggatgctagagtgtatgccgaccccatggcgcttaaggatttcaaagagtttgcatcaggcaggaagtccactaccctagacattctgacagaaatcgccaccttgccaacttacttaagtagcaaggctaaactggccctcgataatattgtcatgctgcacacgaccgagaaagggggccgcgcttaccagcacgcacttaacgaactgcctgagtcgctcgagacattgatgctggtagccctactgggtgctatgactgccggcatcttcctctttttcatgcaggggaaaggaataggcaaactttctatgggtctgatcgcaattgcggtggcctccgggttattgtgggttgctgaaatccagccccaatggattgccgcaagcatcatactggagttctttctcatggtgctgcttattccagaacctgagaaacagcggaccccgcaggacaatcagctgatctatgtcattctcacaatcttgaccataatcggcctgattgctgccaacgaaatgggattaatcgagaagactaaaacagatttcggcttttaccaagtgaagacggagaccactattctagacgtcgatctgcgacccgcatcagcctggacactctatgctgtggcgaccaccatccttacaccaatgctgagacatactatagaaaatatgagtgccaacttgtctctggcagctattgccaatcaggccgcagttctcatggggctgggaaagggctggcctcttcacaggatggacctcggtgtgcccctgttggctatggggtgctactcccaggtaaacccaacgaccctgacagccagcttagtgatgctactgatccattatgcgatcattggacctggcctccaggctaaagccactcgcgaggcacaaaagcggaccgccgctggtatcatgaaaaatcccacagtcgatggcataaccgttattgaccttgaaccgatctcatacgacccaaagttcgagaaacagctgggacaggtgatgttgctggtcctctgtgtgggacaactgcttttaatgagaactacgtgggcactgtgcgaggtactcacattggccaccggccctattatcactctgtgggaagggaaccccggacgtttttggaacaccacaatagcggtgagtactgctaatatcttcaggggcagctatctagccggtgcagggctggccttttccctcattaagaacgctcagaccccacggcgcggaacaggcacgaccggtgagactcttggcgaaaagtggaaacgacagctgaactctttggatagaaaggagttcgaagagtacaaaaggagcgggatcctggaggttgaccggacagaagccaagtccgcactccgcgatggatcaaaaattaagcacgctgtgtctagaggcagttcgaagatcaggtggattgtcgagcgagggatgatcaaacccaagggaaaagtggtcgacctgggctgtggtagaggcgggtggagctactatatggccaccttaaagaatgtgactgaagttaaagggtacacaaagggcgggcctggacatgaggaaccgatacccatggcgacctatggttggaatcttgtaaagctgcactccggcgtggatgtcttttacaaaccaacggaacaggtggacaccctcctatgcgatattggggagtcttcaagcaaccctacaatcgaagagggacgtactctgagaatcttgaagatggttgaaccctggctgtccagtaaacctgagttctgtattaaggtgctcaatccatatatgcccaccgtcatagaggaacttgagaaactgcaacgcaggcacggcggttctttggtgcggtgccctctgagcagaaactcaacacatgaaatgtactgggtatccggggccagtggaaatatcgtgagctctgttaacactatttccaagatgctcttaaatcgctttaccacaaggcaccgaaaaccaacctatgagaaggacgtcgatctgggcgcaggcactcggtcagtgagcacggaaacagagaagcccgacatgaccatcattgggagaaggcttcagcgcctgcaggaggaacataaagagacttggcactacgatcaggaaaacccgtaccgtacctgggcttatcacggatcgtacgaggccccttctacaggtagtgcatccagcatggtgaatggcgtcgttaagctactcacgaaaccatgggacgtgatccccatggtaacccaactggctatgactgacacaacccctttcgggcagcagcgggtgtttaaggaaaaagtcgatactagaacaccacagcccaagttgggaaccaggatgataatgacaactaccgccaactggctgtgggccctccttggcaagaaaaagtcaccgcgcctgtgtacgcgagaggagttcatctccaaagtgcggtctaatgcggctattggtgcagttttccaagaggaacaggggtggaccagcgccagtgaagctgtgaacgactccagattttgggagttagtcgataaggaaagggccctgcatcaggagggaaaatgcgagagctgcgtgtataatatgatgggcaagcgcgaaaagaaattgggcgagttcgggagagcaaagggatctcgggccatctggtacatgtggctcggtgctaggtttctggagttcgaggcgctaggctttcttaacgaagaccactggttctcacgtgagaacagttggtccggggtagagggagaaggcctgcatcgactcggttatattctggaggatatcgacaaaaaggatggggacttgatatacgccgatgacacagcaggatgggatactcgcattaccgaagacgatctgctcaatgaggagcttatcacagaacaaatggctcctcaccataaaactctggccaaggcaatctttaagttaacctatcagaacaaagttgtgaaggtcctgagacccacgccaaaaggcgccgtgatggacattataagccggaaggaccagaggggctctggacaggtgggaacatacggtttgaataccttcactaacatggaggtccaactcatccgccagatggaagctgagggcgttattacacaggatgacatgcagaatcctaaagggctgaaggaaagagtggagaaatggctaaaggagtgtggagtagatcggcttaagaggatggccatctcgggcgacgattgcgtggtcaaacccctggacgaacgattttcaaccagcctcctgttcttgaacgatatgggtaaggtgcgtaaagacgttccacaatgggatccctccaaggggtggaaaaattggcaggaggtgcctttttgtagtcaccacttccataagatttttatgaaggacggaagatctttagtcgtgccatgccgcaaccaggatgaactgatcggccgggcgaggataagccagggcgcagggtggtccctcagagagactgcctgtcttggaaaggcttacgcccaaatgtggtcactgatgtatttccaccgccgggacctaaggctggcaagtatggctatctgctctgccgtaccgaccgaatggttccccacaagccgaacgacctggtccattcatgctcagcaccagtggatgactacagaggacatgctcaaggtttggaatagagtgtggatcgaggataaccctaatatgaccgacaaaactccagtccactcatgggaagatattccctacttgggtaagcgggaggacctgtggtgtggcagccttatcgggctgtcttccagggccacatgggccaagaacattcataccgcgataacacaggtgcgcaatctcatcggaaaggaagagtatgttgattacatgcctgtgatgaagcgttatagtgccccaagcgaatcggagggcgtcttatga

SEQ ID NO: 15767 - RNA, 9867 nt, synthetic construct
  misc_feature 1..9867: note = derived and/or modified CDS sequence (opt3) from DENV-4__JQ915081__SS-prME
  source 1..9867: mol_type = other RNA
agcaccatgaccctgctctgccttatccccactgtgatggcattccacctgtccacgagggacggcgagcctttgatgattgtcgctaagcatgaaagggggcggccattactgtttaagaccacagaggggataaacaagtgtactctaatcgcaatggatctcggtgaaatgtgcgaggacaccgttacatacaaatgtccgctgcttgtgaataccgaacccgaggatattgactgctggtgtaacctgacttctacatgggtaatgtatggaacctgcacgcagtcaggggagcgccgacgtgaaaagcggagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggcttacatgattggccagactggcatccagagaatagtgttctttgttttaatgatgctggtggcaccctcatatgggatgaggtgtgtcggagtgggtaaccgggatttcgttgaaggcgttagcgggggagcctgggtggaccttgtcttggagcacggcggttgcgtgaccacaatggctcaggggaagcctaccctggattttgaactaacgaagactacagccaaagaggtggcgctcctgcgcacctactgtatcgaagcaagtatttccaatatcactacagccacccgatgcccaacgcaaggagagccctatcttaaggaggaacaggaccagcagtacatttgtagaagggatgtcgttgaccggggctggggcaacgggtgcggactgttcggtaaaggcggggtggtaacctgcgctaagtttttgtgttctggaaaaatcacaggcaatctcgtgcaaatagagaacctggaatatactgtcgtggttaccgtgcataatggtgatacacacgccgtcgggaacgacactagcaatcacggcgtgaccgcaacaattacccctcgttccccatcagtagaggttaagttaccggattacggagaactgactctcgactgcgagccccgcagtggcatcgacttcaacgagatgattcttatgaagatgaaaaagaaaacgtggctggtgcataagcagtggtttttggatctacctctgccatggacagctggggccgacaccagcgaagtccactggaattacaaagagagaatggtgactttcaaggtcccccatgcgaaaaggcaggatgtgaccgttctcggatctcaggaaggtgccatgcactccgcactggctggcgccacagaggtggactcaggggatggaaaccacatgtttgctggccatcttaagtgtaaggtacggatggaaaaactgcgaatcaagggtatgagctataccatgtgcagtgggaaattctctatcgacaaggagatggccgagactcaacacggcacaacggtcgtgaaagttaagtacgaaggagcaggcgccccttgtaagattccaatagagatccgcgatgtgaataaagaaaaggtcgtggggagaattatctccagcacccccttcgctgagaacactaactcggtaataaatattgagttggaaccgccttttggagactcttatatcgtgatcggtgttggcgattccgcgctcacactgcattggttcaggaaagggtcaagtattggaaagatgtttgagagcacctaccggggcgcaaaacgcatggccatcttaggtgaaacagcttgggacttcgggtccgtcggcggactgtttacttctctaggcaaggccgtgcaccaggtgttcgggagcgtctataccacgatgtttggaggcgtttcatggatgattagaatactcatcggtttcctggtgctttggattgggaccaacagtaggaatacatccatggcaatgacttgcatcgccgtgggaggcatcaccttgtttctgggtttcacagtacaggctgatatgggctgtgtcgtgagctggaacgggaaggagctcaaatgcggatctggcatttttgttgtggacaatgtccatacttggaccgaacaatacaagttccagcccgagtcaccagcccgtctggcaagtgcgatacttaacgctcacaaagacggggtgtgtggaatccggagcacgacacgactggagaatgttatgtggaagcagattaccaacgaattgaattatgtgctctgggagggcggtcacgatctgactgtagtcgccggggacgtgaaaggagtgttaacaaagggcaagagagcactgacccctcccgtcaacgatctaaaatactcctggaagacttggggtaaagccaagatctttaccccagaagctagaaattctacattcctcattgacggccccgatacgtcggagtgccctaacgaacgccgggcctggaatttctttgaggttgaggactacgggttcggaatgtttaccactaacatctggatgaaattcagagaaggcagctccgaggtgtgtgatcataggctgatgtcagcagctataaaggaccagaaagccgtacacgcggatatggggtattggatcgaaagttctaagaatcaaacatggcagattgagaaggccagccttatcgaagtgaaaacctgcttgtggccaaagacacatactctgtggtccaacggagtcctcgagtcacagatgctgattccgcgcagctacgctggccccttttctcagcacaactatcgacaaggttacgcaacccagacggccgggccttggcacttaggaaaactggagatcgacttcggcgaatgcccaggtacaaccgtgaagatacaggaggattgtgaccatcggggcccctcccttcgtactaccacagctagtgggaaattggttactcagtggtgctgtagaagctgcaccatgcctccactcaggtttctgggagaagatggctgttggtatgggatggagattcgccccctatctgagaaggaagagaatatggtgaagtcccaagtcacagccggacagggcacgtcagaaaccttcagtatgggtctgctctgcctgactctttttgtggaggaatgtttgcggagaagggttacacgaaaacacatgatcctggtggtcgtaattaccttctgcgcaatcatattagggggactcacttggatggacctgcttcgcgcgctgatcatgttgggcgacacaatgagcggccggattgggggacagatccatctcgccattatgaccgtgtttaagatgtcgccgggttacgttctgggcgtgttcctaagaaaactgacgtccagggagactgctctcatggtcatcgggatggccatgaccacagtgttttctatacctcacgatctgatggagcttattgacggaatcagcttgggcctgatcttactcaagattgtaacccatttcgataacactcaggtgggtacactggcactttcactgaccttcatccgtagtacaactcccctagtcatggcttggcgcaccattatggccgtatttttcgtgataacgctcatccccctgtgtcggacatcctgcttgcaaaaacagtctcactgggtggaaattaccgcactgatcttaggggcccaggctctccctgtctatctgatgactcttatgaagggagcgagcagaaggtcctggcccctgaatgagggcattatggccgtgggcttggtttcactcctggggagcgcactactgaagaacgacgtaccacttgctggacctatggtggccggtggcctcctgttggccgcttacgtcatgagtgggtcttccgcagatctgagcttagaaaaagccgcgaatgtgcaatgggacgagatggctgatatcaccggatcgtcacccataatcgaagttaagcaggacgaggatggctcttttagtattcgagacgtggaggaaacaaacatgatcactctcctggtcaaacttgccctgattaccgtgtccggtttgtacccactcgcaatcccggtaacgatggccctgtggtatatatggcaggtcaagacacagcggagcggggctctatgggatgtgccttctcccgcagccacccaaaaagcgactctgagcgagggagtttaccgcattatgcagagaggccttttcggcaagacacaggtgggggtcggaatccacatggaaggtgtgtttcataccatgtggcacgttactaggggctccgtgatctgtcatgagacagggcggctcgaaccatcatgggctgacgtccgaaatgatatgattagttatggaggcggttggagactgggggacaagtgggacaaagaggaggatgtgcaggtattggccatagaacccggaaagaaccctcgccacgtgcaaaccaaaccaggcttattcaagacgctgactggcgagatcggggcagttaccctcgactttaaacccggaacaagcggttctcctattatcaataagaaaggcaaggtcattgggctgtacggaaacggcgtggtgaccaagtccggtgattatgtctcagccatcacacaggctgaaaggataggggagccggactacgaggtagatgaagacatcttccgtaaaaagcggcttactattatggatctgcatccaggagccggcaaaaccaagagaatcttgcccagtattgtgagggaggcactaaaacgccgactgagaacgctcatcctggctcctacacgggttgtggccgcggaaatggaggaagcccttaggggcttaccaatacgctatcagactcccgcagtcaagagcgagcacaccgggcgtgagattgtggacctgatgtgccacgctacatttaccactagactcttgtcctctacccgggttcctaattacaacctgatcgtgatggatgaagcccatttcacagacccgtgctcggtcgctgcaaggggatacatcagcacgcgcgtggagatgggtgaagccgccgctatttttatgactgcgacaccaccaggctcaatcgatcctttcccccagtccaatagtccaatagaggacattgaacgagagatccctgagagatcttggaacacagggttcgactggattaccgattatcaaggaaagactgtatggtttgtgcccagcatcaaagcaggcaatgacatagccaactgtctccggaagtccggtaaaagggttattcagctgtcacgcaagacattcgataccgaatacccaaaaacgaaacttactgactgggattttgtcgtgacaaccgacatctctgagatgggggctaacttcagagccggcagggtgatcgatccgcggcgttgcctgaagcctgtcattttgaccgacggacccgaacgcgttatcctagcaggcccaattcccgtgactcctgccagcgctgcgcagcgaagagggaggataggacggaatccagcccaagaggatgaccagtatgtatttagtggtgatcccctgaaaaacgacgaagatcacgcacattggacagaggctaagatgctcttagacaatatctacacccctgagggcattatcccgacactgttcgggccagaacgcgagaaaactcaggccatcgacggagaatttagacttaggggcgagcagcggaagacgttcgtggagctgatgcgaagaggtgatctccccgtctggttgtcctataaagtggcaagcgccgggatttcttacaaggaccgcgaatggtgttttaccggcgagaggaacaatcaaatactggaagagaacatggaagttgagatctggacacgggagggagaaaagaaaaagctccgtcctaaatggctggatgctagagtgtatgccgaccccatggcgcttaaggatttcaaagagtttgcatcaggcaggaagtccactaccctagacattctgacagaaatcgccaccttgccaacttacttaagtagcaaggctaaactggccctcgataatattgtcatgctgcacacgaccgagaaagggggccgcgcttaccagcacgcacttaacgaactgcctgagtcgctcgagacattgatgctggtagccctactgggtgctatgactgccggcatcttcctctttttcatgcaggggaaaggaataggcaaactttctatgggtctgatcgcaattgcggtggcctccgggttattgtgggttgctgaaatccagccccaatggattgccgcaagcatcatactggagttctttctcatggtgctgcttattccagaacctgagaaacagcggaccccgcaggacaatcagctgatctatgtcattctcacaatcttgaccataatcggcctgattgctgccaacgaaatgggattaatcgagaagactaaaacagatttcggcttttaccaagtgaagacggagaccactattctagacgtcgatctgcgacccgcatcagcctggacactctatgctgtggcgaccaccatccttacaccaatgctgagacatactatagaaaatatgagtgccaacttgtctctggcagctattgccaatcaggccgcagttctcatggggctgggaaagggctggcctcttcacaggatggacctcggtgtgcccctgttggctatggggtgctactcccaggtaaacccaacgaccctgacagccagcttagtgatgctactgatccattatgcgatcattggacctggcctccaggctaaagccactcgcgaggcacaaaagcggaccgccgctggtatcatgaaaaatcccacagtcgatggcataaccgttattgaccttgaaccgatctcatacgacccaaagttcgagaaacagctgggacaggtgatgttgctggtcctctgtgtgggacaactgcttttaatgagaactacgtgggcactgtgcgaggtactcacattggccaccggccctattatcactctgtgggaagggaaccccggacgtttttggaacaccacaatagcggtgagtactgctaatatcttcaggggcagctatctagccggtgcagggctggccttttccctcattaagaacgctcagaccccacggcgcggaacaggcacgaccggtgagactcttggcgaaaagtggaaacgacagctgaactctttggatagaaaggagttcgaagagtacaaaaggagcgggatcctggaggttgaccggacagaagccaagtccgcactccgcgatggatcaaaaattaagcacgctgtgtctagaggcagttcgaagatcaggtggattgtcgagcgagggatgatcaaacccaagggaaaagtggtcgacctgggctgtggtagaggcgggtggagctactatatggccaccttaaagaatgtgactgaagttaaagggtacacaaagggcgggcctggacatgaggaaccgatacccatggcgacctatggttggaatcttgtaaagctgcactccggcgtggatgtcttttacaaaccaacggaacaggtggacaccctcctatgcgatattggggagtcttcaagcaaccctacaatcgaagagggacgtactctgagaatcttgaagatggttgaaccctggctgtccagtaaacctgagttctgtattaaggtgctcaatccatatatgcccaccgtcatagaggaacttgagaaactgcaacgcaggcacggcggttctttggtgcggtgccctctgagcagaaactcaacacatgaaatgtactgggtatccggggccagtggaaatatcgtgagctctgttaacactatttccaagatgctcttaaatcgctttaccacaaggcaccgaaaaccaacctatgagaaggacgtcgatctgggcgcaggcactcggtcagtgagcatcgaaacggagaagcccgacatgacaattatcgggagaaggcttcagcgcctgcaggaggaacataaagagacctggcactacgatcaggaaaacccgtaccgtacttgggcttatcacggatcgtacgaggccccttctaccggtagtgcatccagcatggtgaatggcgtcgttaagctactcacaaaaccatgggacgtgatacccatggtaacgcaactggctatgaccgacactacacctttcgggcagcagcgggtgtttaaggaaaaagtcgataccagaactccacagcccaagttgggaacaaggatgatcatgaccacaactgccaactggctgtgggccctccttggcaagaaaaagtcaccgcgcctgtgtacccgagaggagttcatttccaaagtgcggtctaatgcggctatcggtgcagttttccaagaggaacaggggtggacgagcgccagtgaagctgtgaacgactccagattttgggagttagtcgataaggaaagggccctgcatcaggagggaaaatgcgagagctgcgtgtataatatgatgggcaagcgcgaaaagaaattgggcgagttcgggagagcaaagggatctcgggccatttggtacatgtggctcggtgctaggtttctggagttcgaggcgctaggctttcttaacgaagaccactggttctcacgtgagaacagttggtccggggtagagggagaaggcctgcatcgactcggttatatcctggaggatatagacaaaaaggatggggacttgatttacgccgatgacaccgcaggatgggatacacgcatcactgaagacgatctgctcaatgaggagcttatcaccgaacaaatggctcctcaccataaaacactggccaaggcaatttttaagttaacttatcagaacaaagttgtgaaggtcctgagacccaccccaaaaggcgccgtgatggacataatcagccggaaggaccagaggggctctggacaggtgggaacgtacggtttgaatacattcaccaacatggaggtccaactcattcgccagatggaagctgagggcgttatcactcaggatgacatgcagaatcctaaagggctgaaggaaagagtggagaaatggctaaaggagtgtggagtagatcggcttaagaggatggccatttcgggcgacgattgcgtggtcaaacccctggacgaacgattttcaacaagcctcctgttcttgaacgatatgggtaaggtgcgtaaagacgttccacaatgggatccctccaaggggtggaaaaattggcaggaggtgcctttttgtagtcaccacttccataagatctttatgaaggacggaagatctttagtcgtgccatgccgcaaccaggatgaactgataggccgggcgaggatcagccagggcgcagggtggtccctcagagagaccgcctgtcttggaaaggcttacgcccaaatgtggtcactgatgtatttccaccgccgggacctaaggctggcaagtatggctatttgctctgccgtaccgactgaatggttccccaccagccgaacaacgtggtccatccatgctcagcaccagtggatgaccactgaggacatgctcaaggtttggaatagagtgtggattgaggataaccctaatatgacagacaaaaccccagtccactcatgggaagatatcccctacttgggtaagcgggaggacctgtggtgtggcagccttattgggctgtcttccagggccacttgggccaagaacatacatacagcgatcacccaggtgcgcaatctcattggaaaggaagagtatgttgattacatgcctgtgatgaagcgttatagtgccccaagcgaatcggagggcgtcttatga

SEQ ID NO: 15768 - RNA, 9867 nt, synthetic construct
  misc_feature 1..9867: note = derived and/or modified CDS sequence (opt3) from DENV-4__JQ915084__SS-prME
  source 1..9867: mol_type = other RNA
agcaccatgactctgctctgccttatccccactgtgatggccttccacctgtccacgagggacggcgagcctttgatgattgtcgctaagcatgaaagggggcggccattactgtttaagaccaccgagggaataaacaagtgtactctaatcgcaatggatctcggtgaaatgtgcgaggacaccgttacgtacaagtgtccgctgcttgtgaataccgaacccgaggatattgactgctggtgtaacctgacttctacatgggtaatgtatggaacctgcacgcagtcaggggagcgccgacgtgaaaagcggagtgtggccttgactcctcacagcggaatgggcctcgagaccagggcggaaacatggatgtcctctgagggtgcttggaagcatgcccaacgggtcgagtcgtggatcctgcgcaatccagggttcgcactgctcgccggatttatggcttacatgattggccagactggcatccagagaatagtgttctttgttttaatgatgctggtggcaccctcatatgggatgaggtgtgtcggagtgggtaaccgggatttcgttgaaggcgttagcgggggagcctgggtggaccttgtcttggagcacggcggttgcgtgaccacaatggctcaggggaagcctaccctggattttgaactaacgaagactacagccaaagaggtggcgctcctgcgcacctactgtatcgaagcaagtatttccaatatcactacagccacccgatgcccaacgcaaggagagccctatcttaaggaggaacaggaccagcagtacatttgtagaagggatgtcgttgaccggggctggggcaacgggtgcggactgttcggtaaaggcggggtggtaacctgcgctaagtttttgtgttctggaaaaatcacaggcaatctcgtgcaaatagagaacctggaatatactgtcgtggttaccgtgcataatggtgatacacacgccgtcgggaacgacactagcaatcacggcgtgaccgcaacaattacccctcgttccccatcagtagaggttaagttaccggattacggagaactgactctcgactgcgagccccgcagtggcatcgacttcaacgagatgattcttatgaagatgaaaaagaaaacgtggctggtgcataagcagtggtttttggatctacctctgccatggacagctggggccgacaccagcgaagtccactggaattacaaagagagaatggtgactttcaaggtcccccatgcgaaaaggcaggatgtgaccgttctcggatctcaggaaggtgccatgcactccgcactggctggcgccacagaggtggactcaggggatggaaaccacatgtttgctggccatcttaagtgtaaggtacggatggaaaaactgcgaatcaagggtatgagctataccatgtgcagtgggaaattctctatcgacaaggagatggccgagactcaacacggcacaacggtcgtgaaagttaagtacgaaggagcaggcgccccttgtaagattccaatagagatccgcgatgtgaataaagaaaaggtcgtggggagaattatctccagcacccccttcgctgagaacactaactcggtaataaatattgagttggaaccgccttttggagactcttatatcgtgatcggtgttggcgattccgcgctcacactgcattggttcaggaaagggtcaagtattggaaagatgtttgagagcacctaccggggcgcaaaacgcatggccatcttaggtgaaacagcttgggacttcgggtccgtcggcggactgtttacttctctaggcaaggccgtgcaccaggtgttcgggagcgtctataccacgatgtttggaggcgtttcatggatgattagaatactcatcggtttcctggtgctttggattgggaccaacagtaggaatacatccatggcaatgacttgcatcgccgtgggaggcatcaccttgtttctgggtttcacagtacaggctgatatgggctgtgtcgtgagctggaacgggaaggagctcaaatgcggatctggcatttttgttgtggacaatgtccatacttggaccgaacaatacaagttccagcccgagtcaccagcccgtctggcaagtgcgatacttaacgctcacaaagacggggtgtgtggaatccggagcacgacacgactggagaatgttatgtggaagcagattaccaacgaattgaattatgtgctctgggagggcggtcacgatctgactgtagtcgccggggacgtgaaaggagtgttaacaaagggcaagagagcactgacccctcccgtcaacgatctaaaatactcctggaagacttggggtaaagccaagatctttaccccagaagctagaaattctacattcctcattgacggccccgatacgtcggagtgccctaacgaacgccgggcctggaatttctttgaggttgaggactacgggttcggaatgtttaccactaacatctggatgaaattcagagaaggcagctccgaggtgtgtgatcataggctgatgtcagcagctataaaggaccagaaagccgtacacgcggatatggggtattggatcgaaagttctaagaatcaaacatggcagattgagaaggccagccttatcgaagtgaaaacctgcttgtggccaaagacacatactctgtggtccaacggagtcctcgagtcacagatgctgattccgcgcagctacgctggccccttttctcagcacaactatcgacaaggttacgcaacccagacggccgggccttggcacttaggaaaactggagatcgacttcggcgaatgcccaggtacaaccgtgaagatacaggaggattgtgaccatcggggcccctcccttcgtactaccacagctagtgggaaattggttactcagtggtgctgtagaagctgcaccatgcctccactcaggtttctgggagaagatggctgttggtatgggatggagattcgccccctatctgagaaggaagagaatatggtgaagtcccaagtcacagccggacagggcacgtcagaaaccttcagtatgggtctgctctgcctgactctttttgtggaggaatgtttgcggagaagggttacacgaaaacacatgatcctggtggtcgtaattaccttctgcgcaatcatattagggggactcacttggatggacctgcttcgcgcgctgatcatgttgggcgacacaatgagcggccggattgggggacagatccatctcgccattatgaccgtgtttaagatgtcgccgggttacgttctgggcgtgttcctaagaaaactgacgtccagggagactgctctcatggtcatcgggatggccatgaccacagtgttttctatacctcacgatctgatggagcttattgacggaatcagcttgggcctgatcttactcaagattgtaacccatttcgataacactcaggtgggtacactggcactttcactgaccttcatgcgtagtacaactcccctggtcatggcttggcgcaccatcatggccgtatttttcgtgattacgctcatacccctgtgtcggacatcctgcttgcaaaaacagtctcactgggtggaaatcaccgcactgattttaggggcccaggctctccctgtctatctgatgactcttatgaagggagcgagcagaaggtcctggcccctgaatgagggcatcatggccgtgggcttggtttcactcctggggagcgcactactgaagaacgacgtaccacttgctggacctatggtggccggtggcctcctgttggccgcttacgtcatgagtgggtcttccgcagatctgagcttagaaaaagccgcgaatgtgcaatgggacgagatggctgatattaccggatcgtcacccatcatagaagttaagcaggacgaggatggctcttttagtatccgagacgtggaggaaacaaacatgattactctcctggtcaaacttgccctgatcaccgtgtccggtttgtacccactcgcaattccggtaacgatggccctgtggtatatctggcaggtcaagacacagcggagcggggctctatgggatgtgccttctcccgcagccacccaaaaagcgactctgagcgagggagtttaccgcataatgcagagaggccttttcggcaagacacaggtgggggtcggcattcacatggaaggtgtgtttcataccatgtggcacgttactaggggctccgtgatctgtcatgagacagggcggctcgaaccatcatgggctgacgtccgaaatgatatgatcagttatggaggcggttggagactgggggacaagtgggacaaagaggaggatgtgcaggtattggccattgaacccggaaagaaccctcgccacgtgcaaaccaaaccaggcttattcaagacgctgactggcgagataggggcagttaccctcgactttaaacccggaacaagcggttctcctatcattaataagaaaggcaaggtcatcgggctgtacggaaacggcgtggtgaccaagtccggtgattatgtctcagccattacacaggctgaaaggatcggggagccggactacgaggtagatgaagacatattccgtaaaaagcggcttactatcatggatctgcatccaggagccggcaaaaccaagagaattttgcccagtatcgtgagggaggcactaaaacgccgactgagaacgctcattctggctcctacacgggttgtggccgcggaaatggaggaagcccttaggggcttaccaatccgctatcagactcccgcagtcaagagcgagcacaccgggcgtgagatagtggacctgatgtgccacgctacatttaccactagactcttgtcctctacccgggttcctaattacaacctgattgtgatggatgaagcccatttcacagacccgtgctcggtcgctgcaaggggatacatcagcacgcgcgtggagatgggtgaagccgccgctatctttatgactgcgacaccaccaggctcaattgatcctttcccccagtccaatagtccaatcgaggacatagaacgagagattcctgagagatcttggaacacagggttcgactggatcaccgattatcaaggaaagactgtatggtttgtgcccagcattaaagcaggcaatgacatcgccaactgtctccggaagtccggtaaaagggttatacagctgtcacgcaagacattcgataccgaatacccaaaaacgaaacttactgactgggattttgtcgtgacaaccgacatttctgagatgggggctaacttcagagccggcagggtgatcgatccgcggcgttgcctgaagcctgtcatcttgaccgacggacccgaacgcgttattctagcaggcccaatccccgtgactcctgccagcgctgcgcagcgaagagggaggattggacggaatccagcccaagaggatgaccagtatgtatttagtggtgatcccctgaaaaacgacgaagatcacgcacattggacagaggctaagatgctcttagacaatatatacacccctgagggcatcattccgacactgttcgggccagaacgcgagaaaactcaggccatcgacggagaatttagacttaggggcgagcagcggaagacgttcgtggagctgatgcgaagaggtgatctccccgtctggttgtcctataaagtggcaagcgccgggatctcttacaaggaccgcgaatggtgttttaccggcgagaggaacaatcaaattctggaagagaacatggaagttgagatatggacacgggagggagaaaagaaaaagctccgtcctaaatggctggatgctagagtgtatgccgaccccatggcgcttaaggatttcaaagagtttgcatcaggcaggaagtccactaccctagacatcctgacagaaattgccaccttgccaacttacttaagtagcaaggctaaactggccctcgataatatcgtcatgctgcacacgaccgagaaaggtgggcgcgcttaccagcacgcacttaacgaactgcctgagtcgctcgagacattgatgctggtagccctactgggggctatgactgccggcattttcctctttttcatgcaggggaaaggaatcggcaaactttctatgggtctgatagcaatcgcggtggcctccgggttattgtgggttgctgaaattcagccccaatggatcgccgcaagcattatcctggagttctttctcatggtgctgcttataccagaacctgagaaacagcggaccccgcaggacaatcagctgatttatgtcatcctcacaattttggctatcataggcctgatcgccgcaaacgaaatgggattaattgagaagaccaaaactgatttcggcttttaccaagtgaagacagagacgaccatcctagacgtcgatctgcgacccgcctcagcttggactctctatgcggtggccacaaccattcttaccccaatgctgagacatacaatcgaaaatacaagtgcaaacttgtctctggctgccatagccaatcaggcagctgttctcatggggctgggaaagggctggcctcttcacaggatggacctcggtgtgcccctgttggccatggggtgctactcccaggtaaacccaacgaccctgacagcgagcttagtgatgctactgattcattatgctatcatcggacctggcctccaggccaaagcaactcgcgaggcccaaaagcggaccgctgcaggtattatgaaaaatcccacagtcgatggcatcaccgttatagaccttgaaccgatttcatacgacccaaagttcgagaaacagctgggacaggtgatgttgctggtcctctgtgtgggacaactgcttttaatgagaactacgtgggccctgtgcgaggtactcacattggcgaccggccctatcatgactctgtgggaagggaaccccggacgtttttggaacaccacaattgctgtgagtactgccaatatcttcaggggcagctatctagccggtgcagggctggctttttccctcataaagaacgcccagaccccacggcgcggaacaggcacgaccggtgagactcttggcgaaaagtggaaacgacagctgaactctttggatagaaaggagttcgaagagtacaaaaggagcgggatcctggaggttgaccggacagaagcaaagtccgctctccgcgatggatcaaaaattaagcacgccgtgtctagaggcagttcgaagatcaggtggattgtcgagcgagggatgatcaaacccaagggaaaagtggtcgacctgggctgtggtagaggcgggtggagctactatatggcgaccttaaagaatgtgactgaagttaaagggtacacaaagggcgggcctggacatgaggaaccgattcccatggccacctatggttggaatcttgtaaagctgcactccggcgtggatgtcttttacaaaccaacggaacaggtggacaccctcctatgcgatatcggggagtcttcaagcaaccctacaatagaagagggacgtactctgagaattttgaagatggttgaaccctggctgtccagtaaacctgagttctgtatcaaggtgctcaatccatatatgcccaccgtcatcgaggaacttgagaaactgcaacgcaggcacggcggttctttggtgcggtgccctctgagcagaaactcaacacatgaaatgtactgggtatccggggcaagtggaaatattgtgagctctgttaacactatatccaagatgctcttaaatcgctttaccacaaggcaccgaaaaccaacctatgagaaggacgtcgatctgggcgctggcactcggtcagtgagcacggaaacagagaagcccgacatgaccatcattgggagaaggcttcagcgcctgcaggaggaacataaagagacttggcactacgatcaggaaaacccgtaccgtacctgggcctatcacggatcgtacgaggcaccttctacaggtagtgcttccagcatggtgaatggcgtcgttaagctactcacgaaaccatgggacgtgatccccatggtaacccaactggccatgactgacacaacccctttcgggcagcagcgggtgtttaaggaaaaagtcgatactagaacaccacagcccaagattggaaccaggatgatcatgacaactaccgccaactggttgtgggcgctgctcggcaagaaaaagtcaccgcgcctttgtacgcgagaggagttcatatccaaagtgcggtctaatgctgcaatcggtgccgttttccaagaggaacaggggtggaccagcgctagtgaagccgtgaacgactccagattttgggagctggtcgataaggaaagggcattacatcaggagggaaaatgcgagagctgcgtgtataatatgatgggcaagcgcgaaaagaaactgggcgagttcgggagagccaagggatctcgggctatttggtacatgtggttgggtgcgaggtttctcgagttcgaggccctgggctttctaaacgaagaccactggttctcacgtgagaacagttggtccggggtagagggagaaggccttcatcgactgggttatatcctcgaggatattgacaaaaaggatggggacctgatctacgcagatgacacagctggatgggatactcgcataaccgaagacgatttgctgaatgaggagctcattacagaacaaatggcccctcaccataaaactcttgcaaaggccatctttaagctgacctatcagaacaaagttgtgaaggtcttaagacccacgccaaaaggcgctgtgatggacatcattagccggaaggaccagaggggctctggacaggtgggaacatacggtctgaataccttcactaacatggaggtccaattgatacgccagatggaagccgagggcgttatcacacaggatgacatgcagaatcctaaagggctcaaggaaagagtggagaaatggctgaaggagtgtggagtagatcggctaaagaggatggcgatttcgggcgacgattgcgtggtcaaaccccttgacgaacgattttcaaccagcctactcttcctgaacgatatgggtaaggtgcgtaaagacgttccacaatgggagccctccaaggggtggaaaaattggcaggaagtgcctttttgtagtcaccacttccataagatctttatgaaggatggaagatctttggtcgtgccatgccgcaaccaggacgagttaattggccgggcaaggatcagccagggcgccgggtggtccctgagagaaactgcttgtctcggaaaagcctacgcacaaatgtggtcacttatgtatttccaccgccgggatctgaggctagctagtatggccatatgctctgctgtaccgaccgagtggttccccacaagccgaacgacctggtccatccatgcccagcaccagtggatgactacagaggacatgctgaaggtttggaatagagtgtggattgaagacaaccctaatatgaccgataaaactccagtccactcatgggaggacatcccctacctcggtaagcgggaagatttgtggtgtggcagcctgattgggctttcttccagggcaacatgggcgaaaaacatccataccgccattacacaggtgcgcaatctgataggaaaggaggaatatgttgactacatgcctgtgatgaagcgttatagtagcccatcggagtccgagggcgtcctctga

SEQ ID NO: 15769 - RNA, 9867 nt, synthetic construct
  misc_feature 1..9867: note = derived and/or modified CDS sequence (opt3) from DENV-4__KM190936__SS-prME
  source 1..9867: mol_type = other RNA
agcaccatcacactgctctgccttattcccactgtgatggccttctccctgtctacgagagacggcgagcctttgatgatagtcgctaagcacgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttcaacatgggtaatgtatggcacctgcacgcagagtggggagcgccgacgtgaaaagagaagcgtggccttgactcctcattccggaatgggcctcgagaccagggcggaaacatggatgtcttcggagggtgcttggaaacacgcccaacgggtcgagtcatggattctgcgcaatccagggttcgcactgctcgccggatttatggcttacatgatcggccagactggcatacagagaaccgtgttctttgttttaatgatgctggtggcacccagctatgggatgaggtgtgtcggagtgggtaaccgggatttcgtagaaggcgttagtgggggagcctgggtggaccttgtcttggagcatggcggttgcgtgacaaccatggctcaggggaagcctacgctggattttgaactaactaagacaaccgccaaagaggtggcgctcctgcgcacttactgtatcgaagcatccatttctaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagtttagctgttccggaaaaatcactggcaatttggtgcaaatagagaacctcgaatataccgtcgtggttacagtgcacaatggtgatactcatgccgtcgggaacgacacctcaaatcacggcgtgacagcaatgattacccctcgtagtccaagcgtagaggttaagctgccggattacggagaattaactctggactgcgagccccgctctggcatcgacttcaacgagatgattctcatgaagatgaaaaagaaaacgtggcttgtgcacaagcagtggtttctggatttgcctctaccatggacagctggggccgacacctccgaagtccattggaattacaaagagagaatggtgactttcaaggtcccccacgcgaaaaggcaggatgtgaccgttctgggatcacaggaaggtgccatgcatagcgcactcgctggcgccacagaggtggacagtggggatggaaaccacatgtttgctggccacctgaagtgtaaggtacggatggaaaaacttcgaatcaagggtatgtcttataccatgtgctccgggaaattcagcatcgacaaggagatggccgagactcaacatggcacaacggtcgtgaaagttaagtacgaaggagcaggcgccccttgtaaggtgccaattgagatacgcgatgtcaataaagaaaaggtggtagggagaatcatttcgtctacccccctggctgagaacactaactccgtgacaaatatcgagttggaaccgcctttcggagactcatatatagttattggtgtcggcaacagtgcgctcaccctgcactggtttaggaaagggagctccatcggaaagatgttcgagtctacataccggggcgcaaaacgcatggccatcttaggtgaaactgcttgggattttgggagcgtgggcggactgttcacctcactaggcaaggccgtgcatcaggtctttgggagtgtttatacgaccatgttcggaggcgtgtcctggatgattagaatcctcattggttttctggtgctttggatagggacaaatagcaggaacacttctatggcaatgacctgcatcgccgtaggaggcattacattgttcctgggttttactgtccaggctgacatgggctgtgtggtttcatggagtgggaaggagctcaaatgcggaagcggcatcttcgtggtcgataatgtgcacacctggacggaacaatacaagtttcagcccgagtccccagcccgtctggcatctgcgatccttaacgctcataaagacggggtttgtggaattcggtcgacaacccgactggagaatgtgatgtggaagcagataactaacgaattgaattatgtactctgggagggcggtcacgacctgacagtcgtggccggggatgtgaaaggagtcttaaccaagggcaagagagcactgactcctcccgttagcgacctaaaatactcctggaagacctggggtaaagccaagatcttcacaccagaagctaggaactcaacgtttctcattgatggccccgacaccagtgagtgccctaatgaacgccgggcctggaactctctggaggtggaggattacgggttcggaatgttcactacaaatatctggatgaaatttagagaaggcagctccgaggtatgtgaccacaggcttatgtcagcagctattaaggatcagaaagccgtgcatgcggacatggggtattggatcgaaagctctaagaaccaaacctggcagatagagaaggcctccttgatcgaagtcaaaacatgcctgtggccaaagactcacaccctctggagtaatggagtgctggagagccagatgttaattccgaaatcttacgctggccccttctcccagcataactatcgccaaggttacgcaacgcagacagttgggccttggcacctgggaaagcttgagatcgattttggcgaatgcccaggtaccactgtgaccattcaggaggactgtgatcaccgaggcccctcattgcggacaactaccgccagtgggaaactcgtcacacagtggtgctgtcgtagctgcacgatgcctccactgagattcctaggagaagacggctgttggtatgggatggagatcaggcccctgtcggagaaggaagagaacatggtgaagtcccaagttaccgctggacagggcacttctgaaacatttagcatgggtctcctgtgccttaccttgttcgtggaggaatgtctgcgccggagagtcactaggaaacatatgatattagtagtggttattacactctgcgccatcattctggggggacttacctggatggatctgttgcgagcactcatcatgctgggcgacacgatgtcaggccgcatagggggacagatccacctagcgattatggccgtgtttaagatgagtccgggttacgtcctgggcgtgttcctccggaaactgacttccagagagaccgctcttatggtaatcgggatggccatgacaaccgtgttgtctattcctcatgacctgatggagttaatcgatggaataagcctcggcctgattcttctgaagatcgtcactcagtttgacaatacacaagttggtaccctagcactctccctgacattcatcaggtcaactatgccattggtgatggcttggcgtaccattatggccgtgctgtttgtcgtgacgttaatccccctctgtcgcacaagctgcctgcagaaacagagtcactgggttgaaattaccgcacttatactgggggcccaagctttgcctgtatatctcatgactctgatgaagggagcgtctcggagatcctggcccctaaacgagggcatcatggccgtgggcctggtcagccttctcgggtcggcactgttgaagaatgatgtgccactggctggacctatggttgccggtggcttactcctggccgcttacgtgatgtcagggtctagtgcagacctttccctggaaaaagccgcgaacgtccagtgggatgagatggctgacattaccggaagctctcccatcattgaagtgaagcaggatgaggacggcagcttctccatcagggatgtagaggaaacaaatatgataactttgctcgtcaaactggccctaatcaccgtgtcaggtctgtacccacttgcaattccggttacgatgacactctggtatatgtggcaggtgaagacccaacgaagtggggccctgtgggacgtccctagccccgctgcaactcagaaagccgcgttgtctgagggagtgtaccggatcatgcagcgcggcttatttggcaagacacaggttggggtgggaattcatatggaaggtgtcttccacaccatgtggcacgtgactagaggctccgtaatctgtcatgagacagggaggctggaaccatcatgggctgatgtgcggaacgacatgataagttatggaggcggttggcgactcggggataagtgggacaaagaggaggacgttcaagtcctggccattgaacccggaaagaatcctaaacacgtgcagaccaagccaggccttttcaaaacgctgactggcgagatcggggcagtgaccttggattttaagcccggaacaagcggttcccctatcattaacagaaaaggcaaggtcatagggctatacggaaatggcgtagtgaccaagtctggtgactatgtttcggccatcacacaggctgaacgcattggggagccggattacgaggtggacgaagatatcttcaggaaaaagcgtctgactattatggacctccatccaggagccggcaaaaccaagcggatcctgcccagcatagtcagagaggcacttaaaaggcgcttacgaacgctgatcctcgctcctacaagagtggttgccgcggaaatggaggaagccttgcggggcctgccaattaggtatcagactcccgcagtgaagtcagagcacaccgggcgcgagatcgtcgatctcatgtgccatgctacatttaccactcgtctgctttccagtaccagagtgcctaactacaatctgattgtaatggacgaagcccacttcacagatccgtctagcgtggctgcacggggatacatctccacgagggttgagatgggtgaagccgccgctatatttatgactgcgacccccccaggcgcaacagaccctttcccccaatcaaactctccaattgaggatatcgaacgcgagatccctgagcgaagctggaataccgggtttgactggattactgactatcagggaaagacagtctggttcgtgcccagtatcaaagccggcaacgatatagctaattgcttgagaaagtccggtaaaaaggtgattcagctaagccggaaaacctttgacacggaatacccaaagactaagctgacagattgggacttcgtcgttaccaccgatatctctgagatgggggccaactttagggcaggccgcgtgattgacccgagaaggtgtctcaaacctgtaatcttaactgatggacccgaacgggtgatactggccggcccaattcccgtcacacctgcttcagcggcccaacgtcgcgggcgaatcggaagaaacccagcacaggaggacgatcagtatgtgttctccggtgacccccttaagaatgatgaagaccacgctcattggaccgaggccaaaatgctgctcgataacatctacacacctgagggcattatcccgactttgttcgggccagaaagggagaagacgcaggcaattgacggagaatttcggctgcgcggcgagcaaagaaaaaccttcgttgagctcatgaggcggggtgacctgcccgtgtggcttagttataaggtcgccagcgctgggatatcgtacaaggatcgagaatggtgctttacaggcgagagaaataaccagatcctagaagagaatatggaagtagagatttggactcgcgagggagaaaaaaagaaactgaggcctcggtggttggacgcccgtgtgtatgcggatcccatggcattaaaggacttcaaagagtttgcctctggcagaaagtccatcaccctggatatcctcacagaaattgctagcctgccaacctacctttcaagtagggccaagctggctctcgacaacatagttatgttgcacactacggagcgcgggggacgggcataccagcatgccctgaatgaactacctgagtctctggagaccctcatgcttgtggctctgttaggtgccatgacagcaggcatcttcttgtttttcatgcaggggaaaggaattggcaagctgtccatgggtctcatcactattgcggtcgccagcgggctgctttgggtggctgaaatccaaccccagtggatagccgcatcaatcattctggagtttttcctcatggtcttgctgatcccagaacctgagaaacagcgaaccccgcaggataaccaattaatttatgtgatcctaacaatactgaccattatcggcctcattgctgccaatgaaatgggacttatcgagaagactaaaacagactttggcttctaccaggttaagacggagaccactatactggatgtggacttgagacccgcaagtgcctggacactgtatgctgtagcgaccaccatcctcacaccaatgctgaggcacactattgaaaacacgagcgccaatctttccctcgcagctatcgccaaccaggccgcagtgctgatggggttgggaaaaggctggcctctgcaccgcatggatttaggtgtccccctactggctatggggtgttactctcaggttaatccaaccacactcactgccagccttgtgatgctgttggtccattatgcgattatcggacctggcctgcaagctaaggccacccgggaggcacagaagagaacagccgctggtataatgaaaaaccccaccgtggacggcattactgtaatcgatctcgaaccgatctcctacgacccaaagtttgagaaacagctggggcaagtgatgcttttagttctgtgcgcaggacagctcttgctgatgcgtacgacatgggccttctgtgaggtgctaaccctggcgactggccctattctcaccctttgggaagggaatcccggaaggttctggaacacaactatcgctgtctcaaccgccaacatatttcggggctcttatctggcaggtgccgggttggctttcagtctgattaagaatgcccagacaccacgccgaggaacgggcaccactggtgagacactcggcgaaaaatggaagagacagctgaactcgttagacaggaaggagtttgaagagtacaaacggagcgggatccttgaggtggatcgcaccgaagcaaagtccgctctgaaagacggatctaagattaaacacgccgtctcaagaggcagctccaagatcaggtggatagtggagcgagggatggttaagcccaaaggaaaggtagtggatctcggctgcggtcgggggggatggagttactatatggcgactctaaaaaatgtcacagaagtgaagggctacaccaaaggcgggcctggacatgaggaaccgatccccatggccacgtatggttggaacctggttaagttgcactctggcgtggacgtcttctacaagccaaccgagcaagtggatacactgctctgtgacattggggagagctcatccaatcctactatcgaagagggacgtacccttagagtactgaaaatggtggaaccctggttgagtagcaagcctgagttttgcattaaagttctgaacccatatatgcccacagtcatcgaagagctcgagaagttacagcgcaaacatggcggtaatctggtgaggtgtcctctttctcggaactccactcacgaaatgtactgggtgtcaggggcaagcggaaatattgtctcgtctgttaacaccacaagtaagatgctgctaaatagattcaccactcgccacaggaaaccaacgtatgagaaggatgtggacctcggcgctggcacacgatccgtaagcaccgaaactgagaagcccgatatgaccatcatagggcggagactgcagaggttgcaggaggaacataaagagacatggcactacgaccaagaaaacccgtaccgcacgtgggcctatcatggatcatacgaggcaccttccaccggttctgctagcagtatggtgaatggcgtcgtgaagctgctcactaaaccatgggatgttattcccatggtgacacagcttgccatgaccgacactacaccttttgggcagcagcgtgtcttcaaggaaaaagtggacacccggacaccacaacccaagccgggaactagaatggtaatgaccacgaccgccaactggctgtgggcgttactgggcaagaaaaagaatcctaggttgtgcacacgcgaggagtttatctccaaagttcgaagcaacgctgcaatcggtgccgtgttccaggaagagcaggggtggacttctgcttcagaagccgtcaatgatagtcggttttgggagctcgtggacaaggaaagagcactgcaccaagagggaaaatgtgagtcctgcgtgtataacatgatgggcaagagggaaaagaaactaggcgagttcgggcgcgccaagggaagcagagctatttggtacatgtggcttggtgcgcggtttctggaattcgaggccctcggcttcctgaacgaagatcactggtttgggagggagaattcttggtcgggagtcgagggcgaaggtttgcatcgtctggggtatatactcgaggaaatcgacaaaaaggatggagaccttatgtacgcagatgacaccgctggctgggatacacgaattactgaggacgatctgcagaacgaggaattaatcaccgagcagatggccccccaccataaaattctggcaaaggccatcttcaagttgacgtatcagaataaagttgtgaaggtactccgcccaacacctagaggcgctgtgatggacataatctcacggaaagatcaaagggggagcggacaggtcggtacctacggcctgaacacttttacaaatatggaagtgcagctaattcgccagatggaggccgaaggggttatcacccaagacgacatgcagaaccccaagggacttaaagagagagtggagaagtggctgaaagaatgcggcgtcgatcggctcaagaggatggcgatttccggtgacgattgtgtggtaaagccactggacgagcgattcgggactagtttgttatttctgaatgatatgggaaaagttcgtaaggacatcccccagtgggaaccttctaaaggctggaagaactggcaggaggtgccattctgcagccaccattttcacaaaatattcatgaaggatggcagatccctcgtcgtgccgtgtcgcaatcaagacgaacttattgggcgggcaaggatctcacagggagccggttggagtctgagagagaccgcttgcctaggcaaggcctacgcacagatgtggtctctgatgtattttcaccgccgggatctcaggttggctagcatggccatctgttccgctgttcccacagagtggttccctacgtcacgaaccacttggagcattcatgcccaccatcagtggatgacaaccgaagacatgctgaaagtgtggaacagagtctggatagaggataatccaaacatgactgacaagacacccgtgcactcttgggaagacatcccttaccttgggaaacgggaggatctgtggtgcggatccctcattggcttaagtagcagggcaacctgggcgaagaatatccacacggccattacacaagtacgcaacctgatcggtaaagaagagtatgtggactacatgccagtcatgaagcgttattcggctccctccgagtctgaaggggttttgtga

SEQ ID NO: 15770 - RNA, 9867 nt, synthetic construct
  misc_feature 1..9867: note = derived and/or modified CDS sequence (opt3) from DENV-4__JQ915090__SS-prME
  source 1..9867: mol_type = other RNA
agcaccatgacactgctctgccttatcccaactgtgatggccttccacctgtccacgagggacggcgagcctttgatgattgtcgctaagcatgaaagggggcggccattactgtttaagaccacagaggggataaacaagtgtactctaatcgcaatggatctcggtgaaatgtgcgaggacaccgttacatacaagtgtccgctgcttgtgaataccgaacccgaggatattgactgctggtgtaacctgacttctacatgggtaatgtatggaacctgcacgcagtcaggggagcgccgacgtgaaaagcggagtgtggccttgactcctcacagcggaatgggcctcgagaccagggcggaaacatggatgtcctctgagggtgcttggaagcatgcccaacgggtcgagtcgtggatcctgcgcaatccagggttcgcactgctcgccggatttatggcttacatgattggccagactggcatccagagaatagtgttctttgttttaatgatgctggtggcaccctcatatgggatgaggtgtgtcggagtgggtaaccgggatttcgttgaaggcgttagcgggggagcctgggtggaccttgtcttggagcacggcggttgcgtgaccacaatggctcaggggaagcctaccctggattttgaactagccaagacgactgcgaaagaggtggcactcctgcgcacatactgtatcgaagccagtatttccaatatcaccactgctacacgatgcccaacccaaggagagccctatcttaaggaggaacaggaccagcagtacatttgtagaagggatgtcgttgaccggggctggggcaacgggtgcggactgttcggtaaaggcggggtggtaacgtgcgccaagtttttgtgttctggaaaaatcaccggcaatctcgtgcaaatagagaacctggaatatacagtcgtggttactgtgcataatggtgatacccacgcagtcgggaacgacacaagcaatcacggcgtgactgctaccattacacctcgttccccatcagtagaggttaagttaccggattacggagaactgaccctcgactgcgagccccgcagtggcatcgacttcaacgagatgattcttatgaagatgaaaaagaaaacttggctggtgcataagcagtggtttttggatctacctctgccatggacggccggggcggacacaagcgaagtccactggaattacaaagagagaatggtgaccttcaaggtcccccatgccaaaaggcaggatgtgactgttctcggatctcaggaaggtgcaatgcactccgctctggccggcgctaccgaggtggactcaggggatggaaaccacatgtttgccggccatcttaagtgtaaggtacggatggaaaaactgcgaatcaagggtatgagctatacaatgtgcagtgggaaattctctatcgacaaggagatggcagagacccaacacggcactacagtcgtgaaagttaagtacgaaggagccggcgctccttgtaagattccaatagagatccgcgatgtgaataaagaaaaggtcgtggggagaattatctccagcacgcccttcgcggagaacaccaactcggtaataaatattgagttggaaccgccttttggagactcttatatcgtgatcggtgttggcgattccgcactcactctgcattggttcaggaaagggtcaagtattggaaagatgtttgagagcacataccggggcgccaaacgcatggctatcttaggtgaaaccgcctgggacttcgggtccgtcggcggactgtttacatctctaggcaaggcagtgcaccaggtgttcgggagcgtctatactaccatgtttggaggcgtttcatggatgattagaatactcatcggtttcctggtgctttggattgggacgaacagtaggaatacctccatggccatgacatgcatcgctgtgggaggcatcactttgtttctgggtttcaccgtacaggccgatatgggctgtgtcgtgagctggaacgggaaggagctcaaatgcggatctggcatttttgttgtggacaatgtccatacatggactgaacaatacaagttccagcccgagtcaccagcacgtctggcgagtgctatacttaacgcccacaaagacggggtgtgtggaatccggagcaccacgcgactggagaatgttatgtggaagcagattacaaacgaattgaattatgtgctctgggagggcggtcacgatctgaccgtagtcgcaggggacgtgaaaggagtgttaactaagggcaagagagccctgacacctcccgtcaacgatctaaaatactcctggaagacctggggtaaagctaagatctttactccagaagccagaaattctaccttcctcattgacggccccgatacatcggagtgccctaacgaacgccgggcatggaatttctttgaggttgaggactacgggttcggaatgtttacgaccaacatctggatgaaattcagagaaggcagctccgaggtgtgtgatcataggctgatgtcagctgccataaaggaccagaaagcggtacacgccgatatggggtattggatcgaaagttctaagaatcaaacttggcagattgagaaggctagccttatcgaagtgaaaacatgcttgtggccaaagacccatacactgtggtccaacggagtcctcgagtcacagatgctgattccgcgcagctacgcaggccccttttctcagcacaactatcgacaaggttacgccactcagaccgctgggccttggcacttaggaaaactggagatcgacttcggcgaatgcccaggtacgacagtgaagatacaggaggattgtgaccatcggggcccctcccttcgtaccactaccgccagtgggaaattggttacacagtggtgctgtagaagctgcactatgcctccactcaggtttctgggagaagatggctgttggtatgggatggagattcgccccctatctgagaaggaagagaatatggtgaagtcccaagtcaccgcaggacagggcacatcagaaacgttcagtatgggtctgctctgcctgaccctttttgtggaggaatgtttgcggagaagggttactcgaaaacacatgatcctggtggtcgtaattacattctgcgcgatcatattagggggactcacctggatggacctgcttcgcgccctgatcatgttgggcgacactatgagcggccggattgggggacagatccatctcgctattatgacagtgtttaagatgtcgccgggttacgttctgggcgtgttcctaagaaaactgacctccagggagacggccctcatggtcatcgggatggcaatgactaccgtgttttctatacctcacgatctgatggagcttattgacggaatcagcttgggcctgatcttactcaagattgtaacacatttcgataacacccaggtgggtactctggctctttcactgacattcatgcgtagtaccacacccctagtcatggcctggcgcactatcatggcagtatttttcgtgattaccctcatacccctgtgtcggacgtcctgcttgcaaaaacagtctcactgggtggaaatgacagccctgatcttaggggctcaggcgctccctgtctatctgatgacccttatgaagggagccagcagaaggtcctggcccctgaatgagggcattatggcagtgggcttggtttcactcctggggagcgctctactgaagaacgacgtaccacttgccggacctatggtggccggtggcctcctgttggctgcatacgtcatgagtgggtcttccgccgatctgagcttagaaaaagcggctaatgtgcaatgggacgagatggccgatatcactggatcgtcacccattatcgaagttaagcaggacgaggatggctcttttagtatacgagacgtggaggaaaccaacatgatcacactcctggtcaaacttgcactgattactgtgtccggtttgtacccactcgccatcccggtaaccatggctctgtggtatatttggcaggtcaagacgcagcggagcggggcactatgggatgtgccttctcccgccgcgacacaaaaagctaccctgagcgagggagtttaccgcatcatgcagagaggccttttcggcaagactcaggtgggggtcggaatacacatggaaggtgtgtttcatacaatgtggcacgttaccaggggctccgtgatttgtcatgagactgggcggctcgaaccatcatgggccgacgtccgaagtgatatgatcagctatggaggcggttggagactgggggacaagtgggacaaagaggaggatgtgcaggtattggcaatcgaacccggaaagaatcctcgccacgtgcaaacaaaaccaggcttattcaagaccctgacgggcgagattggggccgttactctcgactttaaacccggaacctctggttcccctataatcaacaagaaaggcaaggtcattgggctgtacggaaatggcgtggtgacaaagtcaggtgattatgtcagtgctatcacccaggccgaaaggattggggagccggactacgaggtagatgaagacatcttccgtaaaaagcggcttacaataatggatctgcatccaggagcaggcaaaactaagagaatcttgcccagcattgtgagggaggctctaaaacgccgactgagaaccctcatcctggcccctacgcgggttgtggcggccgaaatggaggaagcacttaggggcttaccaattcgctatcagacacccgctgtcaagtccgagcacactgggcgtgagatcgtggacctgatgtgccacgccacctttacaaccagactcttgtcttcgactcgggttcctaactacaatctgatagtgatggatgaagctcatttcaccgacccgtgcagcgtcgcagccaggggatacatttcaacacgcgtggagatgggtgaagccgctgcgatctttatgacggcaactcccccaggctccatcgatcctttcccccagagtaactctccaattgaggacatcgaacgagagatacctgagagaagctggaataccgggttcgactggattacagattatcaaggaaagaccgtatggtttgtgccctccatcaaagccggcaacgacattgctaattgtctccggaagtcaggtaaaagggttatccagctgtctcgcaagactttcgatacagaatacccaaaaaccaaacttacggactgggattttgtcgtgactacagacataagcgagatgggggccaacttcagagcaggcagggtgattgatccgcggcgttgcctgaagcctgtcatcttgaccgacggacccgaacgcgttatcctagccggcccaattcccgtgacccctgctagtgcggcccagcgaagagggaggatcggacggaacccagcacaagaggatgaccagtatgtattttccggtgatcccctgaaaaatgacgaagatcacgctcattggactgaggccaagatgctcttagacaacatttacacacctgagggcataatcccgaccctgttcgggccagaacgcgagaaaacacaggcaattgacggagaatttagacttaggggcgagcagcggaagactttcgtggagctgatgcgaagaggtgatctccccgtctggttgagctataaagtggcctctgctgggatctcatacaaggaccgcgaatggtgttttacgggcgagaggaataaccaaatcctggaagagaatatggaagttgagatttggacccgggagggagaaaagaaaaagctccgtcctaaatggctggatgccagagtgtatgcggaccccatggcacttaaggatttcaaagagtttgcctccggcaggaagagtacaactctagacatactgaccgaaatcgctacattgccaacctacttaagctcgaaggccaaactggctctcgataacattgtcatgctgcacactacggagaaagggggccgcgcataccagcacgcccttaatgaactgcctgagtctctcgagaccttgatgctggtagctctactgggtgccatgacagcaggcatcttcctctttttcatgcaggggaaaggaattggcaaactttccatgggtctgatcgcgatagccgtggctagcgggttattgtgggttgccgaaatccagccccaatggattgcagcttcaatcattctggagttctttctcatggtgctgcttatcccagaacctgagaaacagcggactccgcaggacaaccagctgatatatgtcattctcaccatcttgacaattatcggcctgatagccgcaaatgaaatgggattaatcgagaagaccaaaactgatttcggcttttaccaagtgaagacagagacgaccattctagacgtcgatctgcgacccgccagtgcttggactctctatgcggtggccacaaccatccttaccccaatgctgagacatacaattgaaaacatgtctgcaaatttgtccctggctgccatcgccaaccaggcagctgttctcatggggctgggaaagggctggcctcttcacaggatggacctcggtgtgcccctgttggccatggggtgctacagccaggtaaatccaactacgctgaccgcgtcattagtgatgctactgatacattatgctattatcggacctggcctccaggccaaagcaacacgcgaggcccaaaagcggactgctgcaggtatcatgaaaaaccccaccgtcgatggcattacagttatcgaccttgaaccgataagttacgacccaaagttcgagaaacagctgggacaggtgatgttgctggtcctctgtgtgggacaactgcttttaatgagaaccacttgggccctgtgcgaggtactcacgttggcgacaggccctattatgaccctgtgggaagggaatcccggacgtttttggaacactaccatcgctgtgagcacagccaacattttcaggggctcctatctagccggtgcagggctggctttttctctcatcaagaatgcccagactccacggcgcggaaccggcacaacgggtgagacccttggcgaaaagtggaaacgacagctgaacagcttggatagaaaggagttcgaagagtacaaaaggtccgggatactggaggttgaccggactgaagcaaagtcagctctccgcgatggatctaaaatcaagcacgccgtgagtagaggctcgagcaagattaggtggatcgtcgagcgagggatgattaaacccaagggaaaagtggtcgacctgggctgtggtagaggcgggtggtcctactatatggcgacattaaagaatgtgaccgaagttaaagggtacactaagggcgggcctggacatgaggaaccgatccccatggccacatatggttggaaccttgtaaagctgcactctggcgtggatgtcttttacaaaccaaccgaacaggtggacacgctcctatgcgatattggggagtcaagctccaatcctaccatcgaagagggacgtacactgagaatattgaagatggttgaaccctggctgagttctaaacctgagttctgtattaaggtgctcaacccatatatgcccactgtcatcgaggaacttgagaaactgcaacgcaggcacggcggtagcttggtgcggtgccctctgtcaagaaattccacccatgaaatgtactgggtaagtggggcaagcggaaacatcgtgtcttccgttaatacaatttcaaagatgctcttaaaccgctttactaccaggcaccgaaaaccaacatatgagaaggacgtcgatctgggcgctggcacccggagcgtgtcgactgaaacggagaagcccgacatgacaataatcgggagaaggcttcagcgcctgcaggaggaacataaagagacctggcactacgatcaggaaaatccgtaccgtacttgggcctatcacggatcttacgaggcacctagtaccggttccgctagctcaatggtgaacggcgtcgttaagctactcacaaaaccatgggacgtgattcccatggtaacgcaactggccatgaccgacactacacctttcgggcagcagcgggtgtttaaggaaaaagtcgataccagaactccacagcccaagttgggaacaaggatgatcatgaccacaactgccaattggctgtgggcgctccttggcaagaaaaagtccccgcgcctgtgtacccgagaggagttcatttctaaagtgcggagcaacgctgcaatcggtgccgttttccaagaggaacaggggtggacgagtgctatagaagccgtgaatgactccagattttgggagttagtcgataaggaaagggcactgcatcaggagggaaaatgcgagagctgcgtgtataacatgatgggcaagcgcgaaaagaaattgggcgagttcgggagagccaagggatctcgggctatctggtacatgtggctcggtgcgaggtttctggagttcgaggccctaggctttcttaatgaagaccactggttctcacgtgagaacagttggtccggggtagagggagaaggcctgcatcgactcggttatattctggaggatatcgacaaaaaggatggggacttgatttacgcagatgacaccgctggatgggatacacgcatcactgaagacgatctgctcaacgaggagcttataaccgaacaaatggcccctcaccataaaacactggcaaaggccatttttaagttaacttatcagaataaagttgtgaaggtcctgagacccaccccaaaaggcgctgtgatggacatcatcagccggaaggaccagaggggctctggacaggtgggaacgtacggtttgaacacattcaccaatatggaggtccaactcattcgccagatggaagccgagggcgttataactcaggatgacatgcagaaccctaaagggctgaaggaaagagtggagaaatggctaaaggagtgtggagtagatcggcttaagaggatggcgatctcgggcgacgattgcgtggtcaaacccctggacgaacgattttcaacaagcctcctgttcttgaatgatatgggtaaggtgcgtaaagacgttccacaatgggagccctccaaggggtggaaaaactggcaggaagtgcctttttgtagtcaccacttccataagatttttatgaaggatggaagatctttagtcgtgccatgccgcaatcaggacgagctgatcggccgggcaaggattagccagggcgccgggtggtccctcagagaaaccgcttgtcttggaaaagcctacgcacaaatgtggtcactgatgtatttccaccgccgggatctaaggctggctagtatggccatctgctctgctgtaccgactgagtggttccccaccagccgaacaacgtggtccatacatgcccagcaccagtggatgaccactgaggacatgctcaaggtttggaacagagtgtggatcgaagacaatcctaacatgacagataaaaccccagtccactcatgggaggacattccctacttgggtaagcgggaagatctgtggtgtggcagccttatcgggctgtcttccagggcaacttgggcgaaaaatattcatacagccatcacccaggtgcgcaacctcattggaaaggaggaatatgttgactacatgcctgtgatgaagcgttatagtagcccatcggagtccgagggcgtcttatga

SEQ ID NO: 15771 - RNA, 9867 nt, synthetic construct
  misc_feature 1..9867: note = derived and/or modified CDS sequence (opt3) from DENV-4__KJ160504__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcagaattctcatcggttttctggtactttggattgggactaattccaggaacaccagcatggcaatgacatgcatagccgtcggaggcatcactttgttcctgggttttaccgtgcaggctgacatgggctgtgttgtgtcttggtcagggcgtgagctcaagtgcggaagtggcattttcgtcgtggataatgttcatacgtggacagaacaatacaaatttcagcccgagagcccagcccggctggcatccgcgatccttaacgctcacaaggacggggtgtgtggaatccgatctaccactagactggagaatgtaatgtggaaacagattacaaacgaattgaattatgtcctctgggagggcggtcacgacctgaccgtggtggccggggatgtcaagggagttttaactaaaggcaagagggcactgacccctcccgtgtcggacctaaagtacagctggaaaacatggggtaaggccaaaatattcacgccagaagctcgcaactccacctttctcatcgatggccccgacacttcagagtgccctaatgaacggagagcctggaacagtctggaggtagaggattacgggttcggaatgttcacaaccaatatttggatgaagtttagggaaggctctagcgaggtgtgtgaccatcgccttatgtccgcagctatcaaagatcagaaggccgtccacgcggacatggggtattggattgaatcaagcaaaaaccaaacatggcagatcgagaaggcctctttgatagaagtgaagacttgcctgtggccaaaaacccatacgctctggtccaatggagttctggagagtcagatgttaatcccgaagagctacgctggccccttctctcagcacaactatcgacaaggttacgcaacacagaccgtggggccttggcacctgggaaaacttgagattgattttggcgaatgcccaggtactaccgtcacaatccaggaggactgtgatcatcggggcccctccttgcgtactaccacagcctcagggaagctcgtgacgcagtggtgctgtagaagttgcaccatgcctccactgaggttcctaggagaagacggctgttggtatgggatggagattcgccccctgagcgagaaagaagagaacatggttaagtcgcaagtgactgctggacagggcacatccgaaaccttttctatgggtctcctgtgccttactttgttcgtcgaggaatgtctgcggagaagggtaacacgaaagcacatgatcttagtggttgtgataaccctctgcgccattatcctggggggacttacgtggatggatctgttgcgcgcactcattatgctgggcgacactatgagcggccggatcgggggacagatacatctagcgatcatggccgtctttaaaatgtcaccgggttacgtgctgggcgtattcctcagaaagctgaccagtagggagacagctcttatggtgattgggatggccatgaccactgtcttgtccatccctcacgacctgatggagttaattgatggaatctctctcggcctgatacttctgaaaattgttacacagtttgacaatacccaagtgggtacactagcactcagcctgactttcatccgttccaccatgccattggtgatggcttggcgcacgatcatggccgtcctgtttgtggttacattaattcccctctgtcggacctcatgcctgcagaagcagagccattgggtagaaatcactgcacttattctgggggcccaagctttgcctgtgtatctcatgaccctgatgaaaggagcgagtagaaggtcttggcccctaaacgagggcataatggccgtcggcctggtgtcccttctcgggagcgcactgttgaagaatgatgttccactggctggacctatggtggccggtggcttactcctggccgcttacgtcatgtcggggtcatctgcagaccttagtctggaaaaggccgcgaacgtgcagtgggatgagatggctgacatcacaggatccagccccattatcgaagtaaaacaggatgaggacggctctttcagcattcgagatgtcgaggaaactaatatgatcaccttgctcgtgaagctggccctaataacggtttccggtctgtacccacttgcaatcccgattacaatgaccctctggtatatgtggcaggtgaaaactcaacggtcaggggccctgtgggacgtccctagtcccgctgcaacacagaaggccgcgttgagcgagggagtgtaccgcatcatgcagagaggcttatttggcaaaacccaggttggggtgggaattcacatggaaggtgtcttccacactatgtggcatgtgacaaggggctctgtaatctgtcacgagaccgggcggctggaaccatcctgggctgatgtgcgaaacgacatgatatcatatggaggcggttggagactcggggataagtgggacaaggaggaggacgttcaagtcctggccattgaacccggaaaaaatcctaagcatgtgcagacgaaaccaggccttttcaagactctgaccggcgagatcggggcagtgacattggattttaaacccggaaccagtggtagccctatcattaaccgcaagggcaaagtcatagggctatacggaaatggcgtagtgacaaagtccggtgactatgtttctgccatcactcaggctgaaaggattggggagccggattacgaggtggacgaagatatcttccgtaagaaacggctgaccattatggacctccacccaggagccggcaagacgaaaagaatcctgccctcgatagtcagggaggcacttaagcgccgattaagaacactgatcctcgctcctactcgggtggttgccgcggaaatggaggaagccttgaggggcctgccaattcgctatcagacccccgcagtgaaaagcgagcatacagggcgtgagatcgtcgatctcatgtgccacgctacctttactaccagactgctttcatccacacgggtgcctaactacaatctgattgtaatggacgaagcccacttcacggatccgagttctgtggctgcaaggggatacatcagcactcgcgttgagatgggtgaagccgccgctatatttatgaccgcgacacccccaggcgcaaccgaccctttcccccaatccaactcaccaattgaggatatcgaacgagagatccctgagagatcttggaatactgggtttgactggattacagactatcagggaaagaccgtctggttcgtgcccagcatcaaggccggcaacgatatagctaattgcttgcggaaaagtggtaagaaagtgattcagctatccaggaagacgtttgggactgaatacccaaaaacaaagctgaccgactgggatttcgtcgttaccactgacatcagcgagatgggcgccaactttcgcgcaggaagagtgattgatccgaggcggtgtctcaagcctgtaatcttaacagacggccccgaacgtgtgatactggccgggccaattcccgtcacccctgcttctgcggcccaacgccgaggaagagtgggtaggaacccagcacaggaggatgaccagtatgttttctcaggcgatccccttaaaaatgacgaagatcatgctcactggacagaggccaagatgctgctcgacaacatctacactcctgaggggatcattccgacgttgttcggaccagaacgggagaaaacccaggcaatcgatggcgaatttcgcctgagaggtgagcaaaggaagacattcgtggagctcatgcggcgaggggacctgcccgtctggctttcctataaagtagccagtgctggcattagctacaaggacagagaatggtgctttactggagagcgcaataaccagatactagaagagaatatggaagtggagatctggaccagggagggcgaaaagaaaaagctgcggcctcgttggttggatgccagagtttatgcggaccccatggcattaaaagatttcaaggagtttgcctcggggaggaaatctattacactggacatcctcaccgaaatcgcttccctgccagcctaccttagctcacgcgctaagctggcactcgataacattgtgatgttgcatactacggagcggggaggtcgagcctaccagcacgctctgaatgaactacctgagagtctggagaccctcatgcttgtcgccctgttaggcgcaatgacagcggggatattcttgtttttcatgcagggaaagggcatcggtaaactgtctatggggctcattactatcgccgtggcttccggcctgctttggattgccgaaatccaaccccagtggatagcagctagcatcattctggagtttttcctcatggtcttgctgatcccagaacctgagaagcagagaaccccgcaggacaaccaattaatttatgtgatcctaacagttctgaccataattggactcatcgccgcaaatgaaatgggccttattgagaaaactaagacagattttgggttctaccaggtgaaaacggagaccactatcctggacgtagatttgaggcccgcctcagcttggacactgtatgcggtggccaccaccgtcctcacaccaatgctgcgccacactatagaaaacacgagtgcaaatcttagcctcgctgccatcgccaaccaggcagctgttctgatgggattgggcaagggttggcctctgcatcggatggacttaggggtgcccctactggccatgggatgttactcccaggtcaatccaaccacactcactgcgtctcttgtgatgctgtttgtacactatgctattatcggccctggtttgcaagccaaagcaaccagagaggcccagaagcgtacagctgcaggcattatgaagaaccccaccgtggatgggatcactgttatagacctggaaccgattagctacgatccaaaattcgagaagcagctcggacaagtgatgctgcttgtcttatgcgccggccagctgctcttgatgaggacgacatgggcgttctgtgaggtgctgaccctagctactgggcctatcctgaccctctgggaaggaaatcccggccggttttggaacacaactatcgccgtctccaccgcaaacattttccgcggttcatatcttgccggggctggactggccttttctttgatcaaaaatgcacagacaccacgaagaggcacgggtaccactggcgagacactgggggaaaagtggaaaaggcagctcaacagtctggaccggaaggagttcgaagagtacaagcgctcgggaatattagaggtggacagaaccgaagctaaaagcgcccttaaggatggctccaaaattaagcatgcggtttctagggggtcaagcaaaatccgatggattgtagagcggggaatggtgaagcccaagggcaaagtcgtggacctgggttgcgggcgtggaggctggtcctactatatggccactctcaagaatgttacagaagtgaaaggctacaccaaggggggacctggtcacgaggaaccgatccccatggcaacgtatggctggaacctagtcaaactgcatagtggggtggatgtattttacaagccaaccgagcaagtggacacattgctgtgtgatataggagagtctagctcaaatcctactatcgaagagggcagaaccctccgcgttcttaagatggtcgaaccctggctgtccagtaaacctgagttctgcattaaggtgttgaacccatatatgcccacagtgatcgaagagctggagaaactccagaggaagcacggtgggaatttagtccggtgtcctctgagcagaaactctactcacgaaatgtactgggtttccggagcttcaggcaatattgtgagctcggtaaacaccacatctaaaatgcttctgaatcgctttaccactaggcatcgaaagccaacgtatgagaaagacgtggatctaggcgccgggacacggagtgtctccaccgaaactgagaagcccgacatgaccatcattggaagaaggctccagcgcctgcaggaggaacacaaggagacatggcattacgatcaagaaaacccgtaccgtacgtgggcatatcacggtagctacgaggctccttcaaccggctccgcctctagcatggtgaatggggttgtgaaattgctgactaagccatgggacgtcatccccatggtgacacagctcgccatgaccgatactacacctttcggacagcagcgggtatttaaagaaaaggttgacaccagaacaccacaacccaaaccgggcactaggatggtgatgaccacgaccgcgaactggctttgggctctgttaggtaagaagaaaaatcctcgcctgtgcacacgagaggagttcataagtaaggtccggtccaacgcagccattggggctgtgtttcaggaagagcagggatggactagcgcctctgaagcagtgaatgactcaagattctgggagttggtcgataaagaaagggccctccaccaagagggcaagtgtgagagttgcgtttataacatgatgggcaaacgcgaaaagaagctgggggagtttggaagagctaaaggttcccgggcgatctggtacatgtggctaggcgccaggttccttgaattcgaggcactggggtttctcaacgaagaccattggttcggacgtgagaatagctggtctggcgtggagggtgaagggctgcaccgattgggatatatcctggaggaaattgataagaaagacggcgatctcatgtacgctgacgataccgccggctgggacacacgcataactgaggatgaccttcagaacgaggaactgatcaccgagcagatggcaccccatcacaagattttagccaaagctatctttaagctgacgtatcagaataaggtagtgaaagtcttgagaccaacacctcggggggccgtgatggatattatctcgaggaaggaccaacgcggatcaggtcaggttggcacctacgggctcaacactttcacaaatatggaagtgcagctgataagacagatggaggcggaaggagtcatcacccaagatgacatgcagaaccccaaaggcctaaaggagcgggtggagaaatggcttagggaatgcggtgtagaccgactgaagcgtatggcaattagcggggatgactgtgttgtgaaaccactcgatgagagatttggaacttccctgttgttcttaaatgacatgggcaaggtccgcaaggatatcccccagtgggaacctagtaaaggctggaagaactggcaggaggtgccattttgctctcatcacttccacaaaatttttatgaaggacgggcggagcctggttgtgccgtgtaggaatcaagatgaactcatcggaagagcccgcatatcccagggtgctggctggtcacttcgggagaccgcctgcctggggaaagcatacgctcagatgtggagtctaatgtatttccataggcgagacctgagactcgcctctatggctatttgtagcgccgtccccacagagtggtttcctacgtcccggaccacttggtcaatccacgcacatcaccagtggatgacaaccgaagatatgttgaaggtgtggaacagggtatggatcgaggacaatccaaacatgactgataagacacccgtgcacagctgggaagacattccttacctgggaaaacgcgaggacctttggtgcggctctctgataggtctctccagtcgtgcgacctgggccaagaatatccatacggctattacacaagtcagaaacttaatcgggaaagaagagtatgttgattacatgccagtgatgaagcgatatagcgccccctcggagtccgaaggagtcctgtga

SEQ ID NO: 15772 - RNA, 9867 nt, synthetic construct
  misc_feature 1..9867: note = derived and/or modified CDS sequence (opt3) from DENV-4__GU289913__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaatgattacccctcgttcaccaagtgtagaggttaagctgccggattacggagaattaactctggactgcgagccccgcagcggcatcgacttcaacgagatgattctcatgaagatgaaaaagaaaacgtggcttgtgcataagcagtggtttctggatttgcctctaccatggacagctggggccgacacctctgaagtccactggaattacaaagagagaatggtgactttcaaggtcccccatgcgaaaaggcaggatgtgaccgttctgggatcccaggaaggtgccatgcactcagcactcgctggcgccacagaggtggacagcggggatggaaaccacatgtttgctggccatctgaagtgtaaggtacggatggaaaaacttcgaatcaagggtatgagttataccatgtgctctgggaaattctccatcgacaaggagatggccgagactcaacacggcacaacggtcgtgaaagttaagtacgaaggagcaggcgccccttgtaaggtgccaattgagatacgcgatgtcaataaagaaaaggtggtagggagaatcattagctcgacccccctggctgagaacactaactctgtgacaaatatcgagttggaaccgcctttcggagactcctatatagttattggtgtcggcaactcagcgctcaccctgcattggtttaggaaagggagtagcatcggaaagatgttcgagtccacataccggggcgcaaaacgcatggccatcttaggtgaaactgcttgggattttgggtctgtgggcggactgttcaccagcctaggcaaggccgtgcaccaggtctttgggtcagtttatacgaccatgttcggaggcgtgagttggatgattagaatcctcattggttttctggtgctttggatagggacaaattccaggaacactagcatggcaatgacctgcatcgccgtaggaggcattacattgttcctgggttttactgtccaggctgacatgggctgtgtggtttcttggtcagggaaggagctcaaatgcggaagtggcatcttcgtggtcgataatgtgcatacctggacggaacaatacaagtttcagcccgagagcccagcccgtctggcatccgcgatccttaacgctcacaaagacggggtttgtggaattcggtctacaacccgactggagaatgtgatgtggaagcagataactaacgaattgaattatgtactctgggagggcggtcacgacctgacagtcgtggccggggatgtgaaaggagtcttaaccaagggcaagagagcactgactcctcccgtttcggacctaaaatacagctggaagacctggggtaaagccaagatcttcacaccagaagctaggaactccacgtttctcattgatggccccgacacctcagagtgccctaatgaacgccgggcctggaacagtctggaggtggaggattacgggttcggaatgttcactacaaatatctggatgaaatttagagaaggctctagcgaggtatgtgaccataggcttatgtccgcagctattaaggatcagaaagccgtgcacgcggacatggggtattggatcgaatcaagcaagaaccaaacctggcagatagagaaggcctctttgatcgaagtcaaaacatgcctgtggccaaagactcataccctctggtccaatggagtgctggagagtcagatgttaattccgaaaagctacgctggccccttctctcagcacaactatcgccaaggttacgcaacgcagacagttgggccttggcacctgggaaagcttgagatcgattttggcgaatgcccaggtaccactgtgaccattcaggaggactgtgatcatcgaggcccctccttgcggacaactaccgcctcagggaaactcgtcacacagtggtgctgtcgtagttgcacgatgcctccactgagattcctaggagaagacggctgttggtatgggatggagatcaggcccctgagcgagaaggaagagaacatggtgaagtcgcaagttaccgctggacagggcacttccgaaacattttctatgggtctcctgtgccttaccttgttcgtggaggaatgtctgcgccggagagtcactaggaaacacatgatattagtagtggttattacactctgcgccatcattctggggggacttacctggatggatctgttgcgagcactcatcatgctgggcgacacgatgagcggccgcatagggggacagatccatctagcgattatggccgtgtttaagatgtcaccgggttacgtcctgggcgtgttcctccggaaactgactagtagagagaccgctcttatggtaatcgggatggccatgacaaccgtgttgtccattcctcacgacctgatggagttaatcgatggaatatctctcggcctgattcttctgaagatcgtcactcagtttgacaatacacaagttggtaccctagcactcagcctgacattcatcaggtccactatgccattggtgatggcttggcgtaccattatggccgtgctgtttgtcgtgacgttaatccccctctgtcgcacatcatgcctgcagaaacagagccattgggttgaaattaccgcacttatactgggggcccaagctttgcctgtatatctcatgactctgatgaagggagcgagtcggagatcttggcccctaaacgagggcatcatggccgtgggcctggtctcccttctcgggagcgcactgttgaagaatgatgtgccactggctggacctatggttgccggtggcttactcctggccgcttacgtgatgtcggggtcatctgcagaccttagtctggaaaaagccgcgaacgtccagtgggatgagatggctgacattaccggatccagccccatcattgaagtgaagcaggatgaggacggctctttcagcatcagggatgtagaggaaacaaatatgataactttgctcgtcaaactggccctaatcaccgtgtccggtctgtacccacttgcaattccggttacgatgacactctggtatatgtggcaggtgaagacccaacgatcaggggccctgtgggacgtccctagtcccgctgcaactcagaaagccgcgttgagcgagggagtgtaccggatcatgcagcgcggcttatttggcaagacacaggttggggtgggaattcacatggaaggtgtcttccacaccatgtggcatgtgactagaggctctgtaatctgtcacgagacagggaggctggaaccatcctgggctgatgtgcggaacgacatgatatcatatggaggcggttggcgactcggggataagtgggacaaagaggaggacgttcaagtcctggccattgaacccggaaagaatcctaaacatgtgcagaccaagccaggccttttcaaaacgctgactggcgagatcggggcagtgaccttggattttaagcccggaacaagtggtagccctatcattaacagaaaaggcaaggtcatagggctatacggaaatggcgtagtgaccaagtccggtgactatgtttctgccatcacacaggctgaacgcattggggagccggattacgaggtggacgaagatatcttcaggaaaaagcgtctgactattatggacctccacccaggagccggcaaaaccaagcggatcctgccctcgatagtcagagaggcacttaaaaggcgcttacgaacgctgatcctcgctcctacaagagtggttgccgcggaaatggaggaagccttgcggggcctgccaattaggtatcagactcccgcagtgaagagcgagcataccgggcgcgagatcgtcgatctcatgtgccacgctacatttaccactcgtctgctttcatccaccagagtgcctaactacaatctgattgtaatggacgaagcccacttcacagatccgagttctgtggctgcacggggatacatcagcacgagggttgagatgggtgaagccgccgctatatttatgactgcgacccccccaggcgcaacagaccctttcccccaatccaactcaccaattgaggatatcgaacgcgagatccctgagcgatcttggaataccgggtttgactggattactgactatcagggaaagacagtctggttcgtgcccagcatcaaagccggcaacgatatagctaattgcttgagaaagagtggtaaaaaggtgattcagctatcccggaaaacctttgacacggaatacccaaagactaagctgacagattgggacttcgtcgttaccaccgatatcagcgagatgggggccaactttagggcaggccgcgtgattgacccgagaaggtgtctcaaacctgtaatcttaactgatggacccgaacgggtgatactggccggcccaattcccgtcacacctgcttctgcggcccaacgtcgcgggcgaatcggaagaaacccagcacaggaggacgatcagtatgtgttctcaggtgacccccttaagaatgatgaagaccatgctcactggaccgaggccaaaatgctgctcgataacatctacacacctgagggcattatcccgactttgttcgggccagaaagggagaagacgcaggcaattgacggagaatttcggctgcgcggcgagcaaagaaaaaccttcgttgagctcatgaggcggggtgacctgcccgtgtggctttcctataaggtcgccagtgctgggataagctacaaggatcgagaatggtgctttacaggcgagagaaataaccagatcctagaagagaatatggaagtagagatttggactcgcgagggagaaaaaaagaaactgaggcctcggtggttggacgcccgtgtgtatgcggatcccatggcattaaaggacttcaaagagtttgcctcgggcagaaagtctatcaccctggatatcctcacagaaattgcttccctgccaacctaccttagctcaagggccaagctggctctcgacaacatagttatgttgcatactacggagcgcgggggacgggcataccagcacgccctgaatgaactacctgagagtctggagaccctcatgcttgtggctctgttaggtgccatgacagcaggcatcttcttgtttttcatgcaggggaaaggaattggcaagctgtctatgggtctcatcactattgcggtcgcctccgggctgctttgggtggctgaaatccaaccccagtggatagccgcaagcatcattctggagtttttcctcatggtcttgctgatcccagaacctgagaaacagcgaaccccgcaggataaccaattaatttatgtgatcctaacaatactgaccattatcggcctcattgctgccaatgaaatgggacttatcgagaagactaaaacagactttggcttctaccaggttaagacggagaccactatactggatgtggacttgagacccgcatcagcctggacactgtatgctgtagcgaccaccatcctcacaccaatgctgaggcacactattgaaaacacgagtgccaatcttagcctcgcagctatcgccaaccaggccgcagtgctgatggggttgggaaaaggctggcctctgcatcgcatggatttaggtgtccccctactggctatggggtgttactcccaggttaatccaaccacactcactgcctctcttgtgatgctgagcgtccactatgcgattatcggacctggcttgcaagctaaggccacccgggaggcacagaagagaacagccgctggtataatgaaaaaccccaccgtggacggcattactgtaatcgatctggaaccgatctcctacgacccaaagtttgagaaacagctcgggcaagtgatgctgcttgttttatgcgcaggacagctgctcttgatgcgtacgacatgggccttctgtgaggtgctgaccctagcgactggccctattctgaccctctgggaagggaatcccggaaggttctggaacacaactatcgctgtctcaaccgccaacatatttcggggctcttatcttgcaggtgccgggctggctttcagtttgattaagaatgcccagacaccacgccgaggaacgggcaccactggtgagacactgggcgaaaaatggaagagacagctcaactcgctggacaggaaggagtttgaagagtacaaacggagcgggatcttagaggtggatcgcaccgaagcaaagtccgctcttaaagacggatctaagattaaacatgccgtctcaagaggcagctccaagatcaggtggatagtggagcgagggatggttaagcccaaaggaaaggtagtggatctgggctgcggtcgggggggatggagttactatatggcgactctcaaaaatgtcacagaagtgaagggctacaccaaaggcgggcctggacacgaggaaccgatccccatggccacgtatggttggaacctagttaagctgcattctggcgtggacgtcttctacaagccaaccgagcaagtggatacattgctgtgtgacattggggagagctcatccaatcctactatcgaagagggacgtaccctcagagtacttaaaatggtggaaccctggctgagtagcaagcctgagttttgcattaaagttttgaacccatatatgcccacagtcatcgaagagctggagaagctccagcgcaaacacggcggtaatttagtgaggtgtcctctgtctcggaactccactcacgaaatgtactgggtgtcaggggcaagcggaaatattgtctcgtctgttaacaccacaagtaagatgcttctgaatagattcaccactcgccataggaaaccaacgtatgagaaggatgtggacctaggcgctggcacacgatccgtaagcaccgaaactgagaagcccgatatgaccatcatagggcggagactccagaggctgcaggaggaacacaaagagacatggcattacgaccaagaaaacccgtaccgcacgtgggcctatcacggatcatacgaggcaccttccaccggttctgctagcagtatggtgaatggcgtcgtgaagttgctgactaaaccatgggatgttattcccatggtgacacagctcgccatgaccgacactacaccttttgggcagcagcgtgtcttcaaggaaaaagtggacacccggacaccacaacccaagccgggaactagaatggtaatgaccacgaccgccaactggctttgggcgctgttaggcaagaaaaagaatcctaggctgtgcacacgcgaggagtttatctccaaagttcgaagcaacgctgcaatcggtgccgtgttccaggaagagcaggggtggacttctgcttcagaagccgtcaatgatagtcggttttgggagttggtggacaaggaaagagcactccaccaagagggaaaatgtgagtcctgcgtgtataacatgatgggcaagagggaaaagaaactgggcgagttcgggcgcgccaagggaagcagagctatttggtacatgtggctaggtgcgcggtttcttgaattcgaggccctgggcttcctcaacgaagatcattggtttgggagggagaattcttggtcgggagtcgagggcgaaggtctgcaccgtttggggtatatactggaggaaatcgacaaaaaggatggagacctcatgtacgcagatgacaccgctggctgggatacacgaattactgaggacgatcttcagaacgaggaactgatcaccgagcagatggccccccatcacaaaattttagcaaaggccatcttcaagctgacgtatcagaataaagttgtgaaggtattgcgcccaacacctagaggcgctgtgatggacataatctcacggaaagatcaaagggggagcggacaggtcggtacctacggcctcaacacttttacaaatatggaagtgcagctgattcgccagatggaggccgaaggggttatcacccaagacgacatgcagaaccccaagggactaaaagagagagtggagaagtggcttaaagaatgcggcgtcgatcggctgaagaggatggcgatttccggtgacgattgtgtggtaaagccactcgacgagcgattcgggactagtctgttgtttttaaatgatatgggaaaagttcgtaaggacatcccccagtgggaaccttctaaaggctggaagaactggcaggaggtgccattctgcagccatcactttcacaaaatattcatgaaggatggcagatccctggtcgtgccgtgtcgcaatcaagacgaactcattgggcgggcaaggatctcacagggagccggttggagtcttagagagaccgcttgcctgggcaaggcctacgcacagatgtggtctctaatgtattttcatcgccgggatctgaggctcgctagcatggccatctgttccgctgttcccacagagtggttccctacgtcacgaaccacttggagcattcacgcccatcaccagtggatgacaaccgaagacatgttgaaagtgtggaacagagtctggatagaggataatccaaacatgactgacaagacacccgtgcactcttgggaagacatcccttacctggggaaacgggaggatctttggtgcggatccctgattggcctcagtagcagggcaacctgggcgaagaatatccatacggccattacacaagtacgcaacttaatcggtaaagaagagtatgtggactacatgccagtcatgaagcgttattcggctccctccgagtctgaaggggttctgtga

SEQ ID NO: 15773 - RNA, 9867 nt, synthetic construct
  misc_feature 1..9867: note = derived and/or modified CDS sequence (opt3) from DENV-4__KJ579243__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttgccttgtattgtggattgggaccaattcaaggaacacaagtatggcaatgacttgtatagccgtcggaggcatcaccctgtttctcggtttcacggtgcaggctgacatgggctgcgttgtgtcctggagcgggcgtgagctgaagtgtggatctggcatttttgtcgtggataatgttcatacatggaccgaacaatacaaattccagcccgagtcaccagcccggcttgcaagtgcgatcctgaacgctcacaaggacggggtgtgcggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccggtctcaagtactcttggaaaacgtggggcaaggctaaaatatttaccccagaagcccgcaactcgactttcctgatcgacgggcccgatacaagcgagtgtcctaatgaacggagagcatggaactcctttgaggtggaggactacggattcggcatgttcaccacaaatatttggatgaagtttagggaagggtcaagtgaggtatgcgatcatcgccttatgtctgctgccatcaaagaccagaaggcggtgcacgccgatatgggatattggattgaaagctccaaaaaccaaacttggcagatcgagcgagcttcattgatagaagtcaagacctgcctgtggccaaagacgcatacactctggagcaatggcgtgctggagtctcagatgttaatcccgaaatcctacgcaggtcccttcagtcagcacaactatcggcaagggtacgccacccagactgttggaccttggcacctgggcaagcttgagattgactttggtgaatgtccaggcaccacagtgactatccaggagaactgcgatcatcgtgggcccagcttgagaaccacaacggcttctggaaaactcgtcacccagtggtgttgcaggtcctgtactatgcctccactgcgcttcctaggcgaagacgggtgctggtatggaatggagattcggcccctgtcagagaaggaagagaatatggtgaaaagtcaagttacagccggccagggtaccagcgaaactttttcgatggggctcctgtgtcttacattgttcgtggaggaatgcctgagaaggcgagtcacccgcaagcacatgatcttagcagtagtgataacgctctgtgcgattatcctgggaggccttacttggatggatctgttgcgggccctcattatcctgggcgacaccatgtccgggagaataggaggtcagacacatctagctatcatggccgtttttaagatgtctccgggctacgtgctgggggtcttcctcaggaaactgaccagccgtgagactgcacttatggtgattggaatggctatgacaaccacattgtcaatccctcacgatctgatggagttaattgacggcatcagtctcggtctgatacttctgaagattgtaactcagtttgacaacacccaagtggggacgctagccctctccctgacattcatccgctctaccatgagcttggtcatggcatggcggactatcatggccgttctgtttgtggtgaccttaattccactctgcagaacatcctgtctgcagaaacagtcacattgggtcgaaatcactgctcttattctgggagcgcaagccttgcccgtgtatctcatgaccctgatgaagggcgcaagcaggcgaagttggcctctaaatgagggcataatggctgttgggctggtatctcttctcggatccgccctgttgaaaaacgatgtgcccctggccggtccaatggtcgctggcgggttactcctggcagcctacgtgatgagcggatcgtcagcggacctttctctggaaaaggctgccaatgttcagtgggatgagatggcagacatcacgggcagttcccctattatcgaagtgaagcaggatgaggacggtagcttctctattcgggatgtcgaggaaacaaacatgatcaccttgctcgtgaaactggccctaataactgtaagcgggctgtacccccttgctatcccaattacaatgaccctctggtatatgtggcaggtcaagactcaacgctccggagcactgtgggacgtgccgtcacctgccgcgacacagaaagctgccttgagtgagggcgtttacagaatcatgcagaggggcttatttgggaagacccaggtgggagtcggtattcacatggaaggcgtgttccacacgatgtggcatgttactcgggggagcgtgatctgccacgagaccggacgactggaaccctcttgggcagatgtcagaaatgacatgatatcctatggcggtgggtggcgcctcggagataaatgggacaaggaggaggatgtgcaagtactggccattgaaccaggcaagaaccccaaacatgtgcagacaaagcctggccttttcaaaaccctgacaggggagatcggagctgttactttggactttaagccaggtacctcaggcagtcccatcattaataggaaagggaaggtcataggactatacggcaacggtgtggtgacgaaaagcggggactatgtctccgccatcacacaggcagaacgtattggagagcctgattacgaggtagacgaagatatcttccggaagaagagactgactattatggacctccacccgggcgctggcaaaaccaagaggatcctgccatctatagtgcgcgaggcccttaaacgaagattacggacactgatcctcgcgcccaccagggttgtggccgcagaaatggaggaagctttgcgcgggctgcctattcgttatcagactccagccgtcaagtcggagcataccggaagagagatcgtggatctcatgtgccacgctacatttacgactcggctgcttagctcaaccagggttcccaattacaacctgattgtgatggacgaagcacacttcacagatccttccagtgtcgccgcccgcggttacatctctacccgagtggagatgggcgaagctgcggcaatatttatgactgccacaccgcccggggctaccgacccattccctcaaagcaattcccccattgaggatatcgaaagagagatcccagagcggtcatggaacacgggatttgactggattactgattatcagggcaaaacagtatggttcgtgccttctatcaaggccggtaatgacatagcaaactgtttgaggaagagcgggaaaaaggttattcagctaagtcgcaaaacctttgacaccgaataccccaagactaaactgacagattgggacttcgtcgtgaccacagatatctccgagatgggcgccaactttagagctggaagggtgattgacccacggcgttgcctcaagccggtcatcttaactgatggccctgaacgcgttatactggcggggcccattccagtgacgcccgccagcgcagctcaacgaagaggaaggatcggtcggaatcctgcccaggaggacgatcagtatgtattctctggcgacccacttaagaacgatgaagaccatgcacactggaccgaggccaaaatgctgctcgataatatctacacacccgaggggattatccctactttgttcggaccggaacgcgagaagacccaggctattgacggcgaatttagactgaggggtgagcaacggaaaacattcgtggagctcatgcgaagaggggatctgccagtctggctttcatataaggtggcctccgcgggcataagttacaaagaccgcgaatggtgttttaccggagagaggaacaatcagatcctagaagagaacatggaagttgagatttggactcgggagggcgaaaagaagaaactgcgtcccaagtggttggacgcaagagtgtatgccgatcctatggctttaaaagacttcaaggagtttgccagcgggaggaaatcgatcacgctggatatcctcaccgaaattgcttctctgcccacatacctttccagccgcgcaaagctggccctcgacaatatagtcatgttgcatactaccgagcggggaggtcgagcttaccagcacgccctgaacgaactaccagagtcactggagacactcatgcttgtagcactgttaggcgcgatgaccgccgggatcttcttgtttttcatgcagggaaagggcattggtaaactgagtatggggctcatcactattgctgtggcctctggcctgctttgggttgcagaaatccaacctcagtggatagctgcctccatcattctggagtttttcctcatggtgttgctgatccccgaaccagagaagcagagaacacctcaggataatcaattaatttatgtcatcctaacgatactgaccattatcggactcattgcagccaacgaaatgggccttatcgagaaaactaagacagactttgggttctaccaggtgaaaaccgagaccacaatactggatgtcgacttgaggccggctagcgcgtggactctgtatgccgtggcaacgaccatcctcacacccatgctgcgccacactattgaaaatacctcagctaaccttagtctcgccgccatcgcaaatcaggctgccgttctgatgggattgggcaagggttggccactgcatcggatggatttaggggtgcctctactggcgatgggatgctacagccaggtaaaccccacaaccctcactgcttcccttgtgatgctgttggtccactatgccattatcggcccaggtctgcaagcaaaagccacgagagaggctcagaagcgtacagcagccggcataatgaagaatcctaccgttgacgggattactgtgatcgatctcgaacccatctcttacgacccgaaatttgagaagcagctgggacaagtcatgcttttagtgctgtgtgcgggccagctcttgctgatgaggaccacatgggctttctgcgaggtactaactctggccaccgggccaattctcacactttgggaaggaaaccctggccggttctggaacacgaccatcgcagtgagcactgccaatatatttcgcggttcctatctggctggggccggattggcattctcactgattaaaaacgctcagacaccccgaagaggcaccggtactgccggcgagacactcggggaaaagtggaaaaggcagctgaattctttagatcggaaggagtttgaagagtacaagcgcagtggaatccttgaggttgacagaaccgaagcgaaatcggccctgaaggacggcagcaaaattaagcatgcagtgtccagggggtcttcaaaaatccgatggatagtcgagcggggaatggtgaagccaaagggcaaagtcgtggatctcggttgtgggcgtggaggctggagctactatatggctacgctaaagaacgttaccgaagtaaaaggctacacaaaggggggacccggtcacgaggaacctatcccgatggccacttatggctggaatctggtgaaattgcattccggggtcgacgtgttctacaagcccaccgagcaagttgatacactgctctgcgacattggagagagttctagcaacccaactatcgaagagggcagaacccttcgcgtgctgaagatggtcgaaccttggttgtcatccaaacccgagttttgtattaaggtgctgaatccttatatgccaacagtaatcgaagagctcgagaaattacagaggaagcacggtgggaacctggtgcggtgcccccttagtagaaatagcacccacgaaatgtactgggtttctggagcatccggcaacattgtctcaagcgtgaatactacgtcgaaaatgctgctaaaccgcttcacaaccaggcatcgaaagcctacttatgagaaagatgtggacctcggcgctgggacccggtctgtcagtacagaaacggagaagccagatatgaccatcataggaagaaggctgcagcgcttgcaggaggaacacaaggagacttggcattacgaccaagaaaatccctaccgtacatgggcctatcacggttcctacgaggccccgagcaccggctcagcgtcctctatggttaacggggtggtaaaactgctcactaagccttgggatgtgattccaatggtcacacagcttgctatgaccgacacaactccctttggacagcagcgggtgttcaaagaaaaggttgataccagaacgcctcaaccaaaacccggcaccaggatggtgatgacaactaccgcaaattggctgtgggccttactgggtaagaagaaaaacccgcgcttgtgtacacgagaggagtttatcagcaaggtccggagtaatgctgccatcggggcagtgttccaggaagagcagggatggacttccgccagcgaagctgtaaacgactctagattttgggagctcgttgacaaagaaagggcgctgcaccaagagggcaagtgcgagtcatgcgtgtataacatgatgggcaaacgcgaaaagaagctaggggagttcggaagagccaaaggtagtcgggcaatttggtacatgtggcttggcgctaggtttctggaattcgaggccctcgggttcctgaatgaagatcattggtttggacgtgagaactcctggagcggcgtcgagggtgaagggttgcaccgactgggatatatactcgaggaaatcgacaagaaagatggcgaccttatgtacgcagatgacaccgccggctgggatacgcgcattacagaggacgatctgcagaatgaggaattaatcaccgagcagatggctcctcatcacaagattctggccaaagcgatcttcaagttgacttatcagaacaaggtggtgaaagtcctcagacccacaccacggggggcagttatggacataatctctaggaaggatcaacgcggatcgggtcaggtgggcacctacgggctgaatacttttaccaacatggaagtacagctaattagacagatggaggccgaaggagtgatcacacaagacgatatgcagaatcctaaaggccttaaggagcgggtcgagaaatggctgagggaatgtggtgtggaccgactcaagcgtatggctatttcaggggacgattgcgttgtgaaacccctggacgagagattcggaacgagcttgttatttctgaacgatatgggcaaggtccgcaaggacatcccacagtgggaaccctccaaaggctggaagaattggcaggaggtgcctttctgtagtcatcactttcacaaaatattcatgaaggatgggcggtctctcgtagttccatgcaggaaccaagacgaacttattggaagagcccgcatcagccagggtgcaggctggtccctgcgggagaccgcttgtctagggaaagcctacgctcagatgtggtcactgatgtattttcataggcgagatctcagattggccagtatggcaatctgctctgcggtgccgactgagtggttccccacaagccggaccacttggtccattcacgcccatcaccagtggatgacaaccgaagacatgctgaaggtctggaatagggtgtggatagaggataaccctaatatgatcgacaagacgccagttcactcatgggaagatattccctaccttggaaaacgcgaggacctgtggtgtggcagcctcatcggtttatcttcccgtgctacatgggccaagaacattcataccgcaatcactcaagtgagaaatctgatagggaaagaagagtatgtcgactacatgcctgtgatgaagcgatatagtgctccaagcgagtcggaaggagtattgtga

SEQ ID NO: 15774 - RNA, 9867 nt, synthetic construct
  misc_feature 1..9867: note = derived and/or modified CDS sequence (opt3) from DENV-4__KJ579246__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatcctgggcgataccatgtccggcagaatagggggacagacacatctagctatcatggccgttttcaagatgtctccgggttacgtgctgggcgtctttctcaggaaactgaccagccgtgagactgcacttatggtgattgggatggctatgacaaccacattgtcaatccctcacgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccaattacaatgaccctctggtatatgtggcaggtcaagactcaacgctccggggcactgtgggatgtgccgtcacctgccgcgacacagaaagctgccttgagtgagggagtttacagaatcatgcagaggggcttattcggcaagacccaggtgggggtcggaattcacatggaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggataaggaggaggacgtgcaagtactggccattgaaccaggaaagaaccccaaacatgtgcagacaaagcctggcctttttaaaaccctgacaggcgagatcggggctgttactttggacttcaagccaggaacctcaggtagtcccatcattaataggaaaggcaaggtcatagggctatacggaaacggcgtggtgacgaaaagcggtgattatgtctccgccatcacacaggcagaacgtattggggagcctgactacgaggtagatgaagacatctttcggaagaagagactgactattatggatctccacccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttatcagactccagccgtcaagtcggagcataccgggagagagatcgtggacctcatgtgccacgctacattcacgactcggctgcttagctcaaccagggttcccaattacaacctgattgtgatggatgaagcacactttacagacccttccagtgtcgccgcccgcggatacatctctacccgagtggagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtatggtttgtgccttctatcaaggccggcaatgacatagcaaactgcttgaggaagagcggtaaaaaggttattcagctaagtcgcaaaaccttcgataccgaataccccaagactaaactgacagactgggattttgtcgtgaccacagacatctccgagatgggggccaacttcagagctggcagggtgattgatccacggcgttgtctcaagccggtcatcttaactgacggacctgaacgcgttatactggcgggccccattccagtgacgcccgccagcgcagctcaacgaagagggaggatcggacggaatcctgcccaggaggatgaccagtatgtattctctggtgatccacttaagaacgacgaagatcatgcacactggaccgaggccaaaatgctgctcgacaatatctacacacccgagggcattatccctactttgtttgggccggaacgcgagaagacccaggctattgatggagaattcagactgaggggcgagcaacggaaaacatttgtggagctcatgcgaagaggtgacctgccagtctggctttcatataaggtggcctccgcggggataagttacaaagaccgcgaatggtgcttcaccggcgagaggaacaatcagatcctagaagagaacatggaagttgagatttggactcgggagggagaaaagaagaaactgcgtcccaagtggttggatgcaagagtgtatgccgaccctatggctttaaaagattttaaggagttcgccagcggcaggaaatcgatcacgctggacatcctcaccgaaattgcttctctgcccacatacctttccagccgcgcaaagctggccctcgataatatagtcatgttgcatactaccgagcgggggggacgagcttaccagcacgccctgaacgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggacaatcaattaatttatgtcatcctaacgatactgaccattatcggcctcattgcagccaacgaaatgggacttatcgagaaaactaagacagatttcggcttttaccaggtgaaaaccgagaccacaatactggacgtcgatttgaggccggctagcgcgtggactctgtatgccgtggcaacgaccatcctcacacccatgctgcgccacactattgaaaatacctcagctaaccttagtctcgccgccatcgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccattatcggaccaggcctgcaagcaaaagccacgagagaggctcagaagcgtacagcagccggtataatgaagaatcctaccgttgatggcattactgtgatcgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaattctcacactttgggaagggaaccctggacggttttggaacacgaccatcgcagtgagcactgccaatatattccgcggctcctatctggctggtgccgggttggcattttcactgattaaaaacgctcagacaccccgaagaggaaccggcactgccggtgagacactcggcgaaaagtggaaaaggcagctgaattctttagaccggaaggagttcgaagagtacaagcgcagtgggatccttgaggttgacagaaccgaagcgaaatcggccctgaaggatggaagcaaaattaagcatgcagtgtccaggggctcttcaaaaatccgatggatagtcgagcgggggatggtgaagccaaagggaaaagtcgtggacctcggctgcggtcgtgggggatggagctactatatggctacgctaaagaacgttaccgaagtaaaaggctacacaaagggcgggcccggacacgaggaacctatcccgatggccacttatggttggaatctggtgaaattgcattccggcgtcgatgtgttttacaagcccaccgagcaagttgacacactgctctgtgatattggggagagttctagcaacccaactatcgaagagggaagaacccttcgcgtgctgaagatggtcgaaccttggttgtcatccaaacccgagttctgcattaaggtgctgaatccttatatgccaacagtaatcgaagagctcgagaaattacagaggaagcacggcggtaacctggtgcggtgtccccttagtagaaatagcacccacgaaatgtactgggtttctggggcatccggaaacattgtctcaagcgtgaatactacgtcgaaaatgctgctaaaccgctttacaaccaggcatcgaaagcctacttatgagaaagacgtggatctcggcgctggcacccggtctgtcagtacagaaacggagaagccagacatgaccatcatagggagaaggctgcagcgcttgcaggaggaacacaaggagacttggcattacgatcaagaaaatccctaccgtacatgggcctatcacggatcctacgaggccccgagcaccggttcagcgtcctctatggttaacggcgtggtaaaactgctcactaagccttgggacgtgattccaatggtcacacagcttgctatgaccgatacaactcccttcgggcagcagcgggtgtttaaagaaaaggttgacaccagaacgcctcaaccaaaacccggaaccaggatggtgatgacaactaccgcaaattggctgtgggccttactgggcaagaagaaaaacccgcgcttgtgcacacgagaggagttcatcagcaaggtccggagtaatgctgccatcggtgcagtgtttcaggaagagcaggggtggacttccgccagcgaagctgtaaacgactctagattctgggagctcgttgataaagaaagggcgctgcaccaagagggaaagtgtgagtcatgcgtgtataacatgatgggcaaacgcgaaaagaagctaggcgagtttgggagagccaaaggaagtcgggcaatttggtacatgtggcttggtgctaggttcctggaattcgaggccctcggctttctgaatgaagaccattggttcgggcgtgagaactcctggagcggagtcgagggcgaaggtttgcaccgactggggtatatactcgaggaaatcgataagaaagacggagatcttatgtacgcagacgataccgccggctgggacacgcgcattacagaggatgacctgcagaatgaggaattaatcaccgagcagatggctcctcatcacaagattctggccaaagcgatctttaagttgacttatcagaacaaggtggtgaaagtcctcagacccacaccacggggcgcagttatggatataatctctaggaaggaccaacgcgggtcgggacaggtgggtacctacggcctgaatactttcaccaacatggaagtacagctaattagacagatggaggccgaaggggtgatcacacaagatgacatgcagaatcctaaaggacttaaggagcgggtcgagaaatggctgagggaatgcggcgtggaccgactcaagcgtatggctatttcaggtgatgactgtgttgtgaaacccctggatgagagatttgggacgagcttgttattcctgaacgacatgggaaaggtccgcaaggatatcccacagtgggaaccctccaaaggctggaagaattggcaggaggtgcctttttgcagtcatcacttccacaaaatatttatgaaggacggccggtctctcgtagttccatgtaggaaccaagatgaacttattgggagagcccgcatcagccagggagcaggttggtccctgcgggagaccgcttgcctaggcaaagcctacgctcagatgtggtcactgatgtatttccataggcgagacctcagattggccagtatggcaatctgttctgcggtgccgactgagtggtttcccacaagccggaccacttggtccattcacgcccatcaccagtggatgacaaccgaagatatgctgaaggtctggaatagggtgtggatagaggacaaccctaatatgatcgataagacgccaattcactcatgggaagacatcccctaccttgggaaacgcgaggacctgtggtgcggaagcctcattggcttatcttcccgtgctacatgggccaagaacatccataccgcaataactcaagttagaaatctgatcggtaaagaagagtatgtggattacatgcctgtcatgaagcgatatagtgctccaagcgagtcggaaggggtgttgtga

SEQ ID NO: 15775 - RNA, 9867 nt, synthetic construct
  misc_feature 1..9867: note = derived and/or modified CDS sequence (opt3) from DENV-4__KJ579248__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatgctgggcgataccatgtccggcagagttgggggacagacacatctagctatcatagccgtgttcaagatgtctccgggttacgtcctgggcgtgtttctcaggaaactgaccagccgtgagactgcacttatggtaatcgggatggctatgacaaccacattgtcaattcctcacgacctgatggagttaatcgacggaattagtctcggcctgatccttctgaagatagtgactcagttcgataacacccaagtcggtacgctagccctctccctgacatttattcgctctaccatgagcttggttatggcatggcggactatcatggccgtgctgttcgtggtcaccttaatcccactctgtagaacatcctgcctgcagaaacagtcacattgggtggaaattactgctcttatcctgggggcgcaagccttgcccgtttatctcatgaccctgatgaagggagcaagcaggcgaagttggcctctaaatgagggcattatggctgtaggcctggtgtctcttctcgggtccgccctgttgaaaaacgacgtccccctggccggaccaatggtggctggtggcttactcctggcagcctacgttatgagcgggtcgtcagcggatctttctctggaaaaggctgccaatgtgcagtgggacgagatggcagatataacgggaagttcccctatcattgaagtcaagcaggacgaggatggcagcttttctatccgggacgtggaggaaacaaacatgattaccttgctcgtaaaactggccctaatcactgtcagcggtctgtacccccttgctataccaatcacaatgaccctctggtatatgtggcaggtgaagactcaacgctccggggcactgtgggatgttccgtcacctgccgcgacacagaaagctgccttgagtgagggagtgtacagaattatgcagaggggcttattcggcaagacccaggtcggggtgggaatccacatggaaggtgttttccacacgatgtggcatgtgactcggggcagcgtcatttgtcacgagaccgggcgactggaaccctcttgggcagacgtgagaaatgatatgatctcctatggaggcggttggcgcctcggggacaaatgggataaggaggaggacgtacaagtgctggccatagaaccaggaaagaaccccaaacatgttcagacaaagcctggcctttttaaaaccctgacaggcgagattggggctgtcactttggacttcaagccaggaacctcaggtagtcccatcatcaataggaaaggcaaggtgattgggctatacggaaacggcgtggtcacgaaaagcggtgattatgtatccgccataacacaggcagaacgtatcggggagcctgactacgaggtggatgaagacatttttcggaagaagagactgactatcatggatctccacccgggagctggcaaaaccaagaggattctgccatctatcgttcgcgaggcccttaaacgaagattacggacactgatactcgcgcccaccagggtggtcgccgcagaaatggaggaagctttgcgcggcctgcctatccgttatcagactccagccgtgaagtcggagcataccgggagagagattgttgacctcatgtgccacgctacattcacgactcggctgcttagctcaaccagggtgcccaattacaacctgatcgtcatggatgaagcacactttacagacccttccagtgtggccgcccgcggatacatttctacccgagtagagatgggtgaagctgcggcaatcttcatgactgccacaccgcccggcgctaccgatccatttcctcaaagcaattcccccatagaggacattgaaagagagatcccagagcggtcatggaacacggggttcgattggatcactgactatcagggaaaaacagtgtggtttgttccttctattaaggccggcaatgacatcgcaaactgcttgaggaagagcggtaaaaaggtcatacagctaagtcgcaaaaccttcgataccgaataccccaagactaaactgacagactgggattttgtggtgaccacagacatttccgagatgggggccaacttcagagctggcagggtcatcgatccacggcgttgtctcaagccggttattttaactgacggacctgaacgcgtgatcctggcgggccccataccagtaacgcccgccagcgcagctcaacgaagagggaggattggacggaatcctgcccaggaggatgaccagtatgtgttctctggtgatccacttaagaacgacgaagatcatgcacactggaccgaggccaaaatgctgctcgacaatatctacacacccgagggcatcattcctactttgtttgggccggaacgcgagaagacccaggctatcgatggagaattcagactgaggggcgagcaacggaaaacatttgtcgagctcatgcgaagaggtgacctgccagtgtggctttcatataaggttgcctccgcggggattagttacaaagaccgcgaatggtgcttcaccggcgagaggaacaatcagatactagaagagaacatggaagtggagatctggactcgggagggagaaaagaagaaactgcgtcccaagtggttggatgcaagagtctatgccgaccctatggctttaaaagattttaaggagttcgccagcggcaggaaatcgattacgctggacatcctcaccgaaatcgcttctctgcccacatacctttccagccgcgcaaagctggccctcgataatattgtaatgttgcatactaccgagcgggggggacgagcttaccagcacgccctgaacgaactaccagagtcactggagacactcatgcttgtggcactgttaggtgcgatgaccgccggcatatttttgttctttatgcaggggaagggaatcggcaaactgagtatgggtctcattactatcgctgttgcctctgggctgctttgggtggcagaaattcaacctcagtggatcgctgcctccataatcctggagttctttctcatggtcttgctgattcccgaaccagagaagcagagaacacctcaggacaatcaattaatctatgtgattctaacgatcctgaccataattggcctcatcgcagccaacgaaatgggacttattgagaaaactaagacagatttcggcttttaccaggtcaaaaccgagaccacaatcctggacgtggatttgaggccggctagcgcgtggactctgtatgccgttgcaacgaccatactcacacccatgctgcgccacactatcgaaaatacctcagctaaccttagtctcgccgccattgcaaatcaggctgccgtgctgatggggttgggaaagggctggccactgcatcggatggacttaggtgtacctctactggcgatggggtgttacagccaggtgaaccccacaaccctcactgcttcccttgtcatgctgttggttcactatgccatcattggaccaggcctgcaagcaaaagccacgagagaggctcagaagcgtacagcagccggtatcatgaagaatcctaccgtggatggcataactgtcattgacctcgaacccatctcttacgatccgaaattcgagaagcagctggggcaagtgatgcttttagtactgtgcgcgggacagctcttgctgatgaggaccacatgggctttctgtgaggtgctaactctggccaccggcccaatcctcacactttgggaagggaaccctggacggttttggaacacgaccattgcagttagcactgccaatatcttccgcggctcctatctggctggtgccgggttggcattttcactgataaaaaacgctcagacaccccgaagaggaaccggcactgccggtgagacactcggcgaaaagtggaaaaggcagctgaattctttagaccggaaggagttcgaagagtacaagcgcagtgggattcttgaggtggacagaaccgaagcgaaatcggccctgaaggatggaagcaaaatcaagcatgcagtctccaggggctcttcaaaaattcgatggatcgtggagcgggggatggtcaagccaaagggaaaagtggttgacctcggctgcggtcgtgggggatggagctactatatggctacgctaaagaacgtaaccgaagtgaaaggctacacaaagggcgggcccggacacgaggaacctataccgatggccacttatggttggaatctggtcaaattgcattccggcgtggatgttttttacaagcccaccgagcaagtggacacactgctctgtgatatcggggagagttctagcaacccaactattgaagagggaagaacccttcgcgtcctgaagatggtggaaccttggttgtcatccaaacccgagttctgcatcaaggtactgaatccttatatgccaacagtgattgaagagctcgagaaattacagaggaagcacggcggtaacctggttcggtgtccccttagtagaaatagcacccacgaaatgtactgggtctctggggcatccggaaacatcgtgtcaagcgtgaatactacgtcgaaaatgctgctaaaccgctttacaaccaggcatcgaaagcctacttatgagaaagacgtcgatctcggcgctggcacccggtctgttagtacagaaattgagaagccagacatgacgatcatagggagaaggctgcagcgcttgcaggaggaacacaaggagacctggcattacgatcaagaaaatccctaccgtacttgggcctatcacggatcctacgaggccccgagcacaggttcagcgtcctctatggtgaacggcgtagtgaaactgctcaccaagccttgggacgtcattccaatggtgactcagcttgctatgacagataccacacccttcgggcagcagcgggtttttaaagaaaaggtggacactagaacccctcaaccaaaacccggaacgaggatggtcatgaccacaactgcaaattggctgtgggccttactgggcaagaagaaaaacccgcgcttgtgcacccgagaggagttcatcagcaaggtgcggagtaatgctgccatcggtgcagtatttcaggaagagcaggggtggacatccgccagcgaagctgttaacgactctagattctgggagctcgtggataaagaaagggcgctgcaccaagagggaaagtgtgagtcatgcgtctataacatgatgggcaaacgcgaaaagaagctaggcgagtttgggagagccaaaggaagtcgggcaatttggtacatgtggcttggtgctaggttcctggaattcgaggccctcggctttctgaatgaagaccattggttcgggcgtgagaactcctggagcggagtggagggcgaaggtttgcaccgactggggtatatactcgaggaaatcgataagaaagacggagatcttatgtacgcagacgatactgccggctgggacacccgcattacggaggatgacctgcagaatgaggaattaatcacagagcagatggctcctcatcacaagattctggccaaagcgatctttaagttgacctatcagaacaaggtggtcaaagttctcagacccactccacggggcgcagtgatggatataatctctaggaaggaccaacgcgggtcgggacaggtaggtacatacggcctgaataccttcactaacatggaagtgcagctaattagacagatggaggccgaaggggtcatcacccaagatgacatgcagaatcctaaaggacttaaggagcgggtggagaaatggctgagggaatgcggcgttgaccgactcaagcgtatggctatttcaggtgatgactgtgtggtcaaacccctggatgagagatttgggacaagcttgttattcctgaacgacatgggaaaggtgcgcaaggatatcccacagtgggaaccctccaaaggctggaagaattggcaggaggtacctttttgcagtcatcacttccacaaaatatttatgaaggacggccggtctctcgttgtgccatgtaggaaccaagatgaacttattgggagagcccgcatcagccagggagcaggttggtccctgcgggagacggcttgcctaggcaaagcctacgctcagatgtggtcactgatgtatttccataggcgagacctcagattggccagtatggcaatctgttctgcggtcccgaccgagtggtttcccactagccggacaacctggtccattcacgcccatcaccagtggatgactacagaagatatgctgaaggtgtggaatagggtttggatagaggacaaccctaatatgatcgataagaccccagtgcactcatgggaagacattccctaccttgggaaacgcgaggacctgtggtgcggaagcctcatcggcttatcttcccgtgctacgtgggccaagaacattcatacagcaatcacccaagtcagaaatctgataggtaaagaagagtatgtggattacatgagtgtaatgaagcgatatagcgctccttcggagtccgaaggggtgttgtga

SEQ ID NO: 15776 - RNA, 9867 nt, synthetic construct
  misc_feature 1..9867: note = derived and/or modified CDS sequence (opt3) from DENV-4__KJ579240__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcagtcacttgcatagccgtgggaggcatcaccctgttcctcggttttacggttcaggctgacatgggctgtgtggtctcctggagcgggcgtgagctgaagtgcggatctggcattttcgtggttgataatgtgcatacatggaccgaacaatacaaatttcagcccgagtcaccagcccggcttgcaagtgcgatcctgaacgctcacaaggacggggtatgtggaatccgaagcactacaagattggagaatgtcatgtggaaacagattaccaacgaactcaattatgtgctgtgggagggcggtcacgacttaactgtggtcgccggggatgttaagggagtgctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtagaggattacgggttcggaatgtttaccacaaatatttggatgaagttcagggaaggctcaagtgaggtgtgtgaccatcgccttatgtctgctgccatcaaagatcagaaggcggtccacgccgacatggggtattggattgaaagctccaaaaaccaaacttggcagatcgagcgagcttcattgatagaagtgaagacctgcctgtggccaaagacgcatacactctggagcaatggagttctggagtctcagatgttaatcccgaaatcctacgcaggcccctttagtcagcacaactatcggcaaggttacgccacccagactgtggggccttggcacctgggaaagcttgagattgatttcggcgaatgcccaggtaccacagtcactatccaggagaactgtgaccatcgtggccccagcttgagaaccacaacggcttctgggaaactcgtgacccagtggtgctgtaggtcctgcactatgcctccactgcgctttctaggagaagatggctgttggtatgggatggagattcggcccctgtcagagaaggaagagaatatggttaaaagtcaagtgacagccggacagggcaccagcgaaactttctcgatgggtctcctgtgccttacattgtttgtcgaggaatgtctgagaaggcgagtaacccgcaagcacatgatcttagcagtggttataacgctctgcgcgattatcctggggggacttacttggatggacctgttgcgggccctcattatgctgggcgataccatgtccggcagaatcgggggacagacacatctagctataatcgccgtgttcaagatgtctccgggttacgtcctgggcgtgtttctcaggaaactgaccagccgtgagactgcacttatggtaattgggatggctatgacaaccacattgtcaatccctcacgacctgatggagttaattgacggaatcagtctcggcctgatacttctgaagattgtgactcagttcgataacacccaagtcggtacgctagccctctccctgacatttatccgctctaccatgagcttggttatggcatggcggactatcatggccgtgctgttcgtggtcaccttaattccactctgtagaacatcctgcctgcagaaacagtcacattgggtggaaatcactgctcttattctgggggcgcaagccttgcccgtttatctcatgaccctgatgaagggagcaagcaggcgaagttggcctctaaatgagggcataatggctgtaggcctggtgtctcttctcgggtccgccctgttgaaaaacgacgtccccctggccggaccaatggtggctggtggcttactcctggcagcctacgttatgagcgggtcgtcagcggatctttctctggaaaaggctgccaatgtgcagtgggacgagatggcagatatcacgggaagttcccctattatcgaagtcaagcaggacgaggatggcagcttttctattcgggacgtggaggaaacaaacatgatcaccttgctcgtaaaactggccctaataactgtcagcggtctgtacccccttgctatcccaattacaatgaccctctggtatatgtggcaggtgaagactcaacgctccggggcactgtgggatgttccgtcacctgccgcgacacagaaagctgccttgagtgagggagtgtacagaatcatgcagaggggcttattcggcaagacccaggtcggggtgggaattcacatggaaggtgttttccacacgatgtggcatgtgactcggggcagcgtcatctgtcacgagaccgggcgactggaaccctcttgggcagacgtgagaaatgatatgatatcctatggaggcggttggcgcctcggggacaaatgggataaggaggaggacgtacaagtgctggccattgaaccaggaaagaaccccaaacatgttcagacaaagcctggcctttttaaaaccctgacaggcgagatcggggctgtcactttggacttcaagccaggaacctcaggtagtcccatcattaataggaaaggcaaggtgatagggctatacggaaacggcgtggtcacgaaaagcggtgattatgtatccgccatcacacaggcagaacgtattggggagcctgactacgaggtggatgaagacatctttcggaagaagagactgactattatggatctccacccgggagctggcaaaaccaagaggatcctgccatctatagttcgcgaggcccttaaacgaagattacggacactgatcctcgcgcccaccagggtggtcgccgcagaaatggaggaagctttgcgcggcctgcctattcgttatcagactccagccgtgaagtcggagcataccgggagagagatcgttgacctcatgtgccacgctacattcacgactcggctgcttagctcaaccagggtgcccaattacaacctgattgtcatggatgaagcacactttacagacccttccagtgtggccgcccgcggatacatctctacccgagtagagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtgtggtttgttccttctatcaaggccggcaatgacatagcaaactgcttgaggaagagcggtaaaaaggtcattcagctaagtcgcaaaaccttcgataccgaataccccaagactaaactgacagactgggattttgtggtgaccacagacatctccgagatgggggccaacttcagagctggcagggtcattgatccacggcgttgtctcaagccggttatcttaactgacggacctgaacgcgtgatactggcgggccccattccagtaacgcccgccagcgcagctcaacgaagagggaggatcggacggaatcctgcccaggaggatgaccagtatgtgttctctggtgatccacttaagaacgacgaagatcatgcacactggaccgaggccaaaatgctgctcgacaatatctacacacccgagggcattatccctactttgtttgggccggaacgcgagaagacccaggctattgatggagaattcagactgaggggcgagcaacggaaaacatttgtcgagctcatgcgaagaggtgacctgccagtgtggctttcatataaggttgcctccgcggggataagttacaaagaccgcgaatggtgcttcaccggcgagaggaacaatcagatcctagaagagaacatggaagtggagatttggactcgggagggagaaaagaagaaactgcgtcccaagtggttggatgcaagagtctatgccgaccctatggctttaaaagattttaaggagttcgccagcggcaggaaatcgatcacgctggacatcctcaccgaaattgcttctctgcccacatacctttccagccgcgcaaagctggccctcgataatatagtaatgttgcatactaccgagcgggggggacgagcttaccagcacgccctgaacgaactaccagagtcactggagacactcatgcttgtggcactgttaggtgcgatgaccgccggcatctttttgttctttatgcaggggaagggaattggcaaactgagtatgggtctcatcactattgctgttgcctctgggctgctttgggtggcagaaatccaacctcagtggatagctgcctccatcattctggagttctttctcatggtcttgctgatccccgaaccagagaagcagagaacacctcaggacaatcaattaatttatgtgatcctaacgatactgaccattatcggcctcattgcagccaacgaaatgggacttatcgagaaaactaagacagatttcggcttttaccaggtcaaaaccgagaccacaatactggacgtggatttgaggccggctagcgcgtggactctgtatgccgttgcaacgaccatcctcacacccatgctgcgccacactattgaaaatacctcagctaaccttagtctcgccgccatcgcaaatcaggctgccgtgctgatggggttgggaaagggctggccactgcatcggatggacttaggtgtacctctactggcgatggggtgttacagccaggtgaaccccacaaccctcactgcttcccttgtcatgctgttggttcactatgccattatcggaccaggcctgcaagcaaaagccacgagagaggctcagaagcgtacagcagccggtataatgaagaatcctaccgtggatggcattactgtcatcgacctcgaacccatctcttacgatccgaaattcgagaagcagctggggcaagtgatgcttttagtactgtgcgcgggacagctcttgctgatgaggaccacatgggctttctgtgaggtgctaactctggccaccggcccaattctcacactttgggaagggaaccctggacggttttggaacacgaccatcgcagttagcactgccaatatattccgcggctcctatctggctggtgccgggttggcattttcactgattaaaaacgctcagacaccccgaagaggaaccggcactgccggtgagacactcggcgaaaagtggaaaaggcagctgaattctttagaccggaaggagttcgaagagtacaagcgcagtgggatccttgaggtggacagaaccgaagcgaaatcggccctgaaggatggaagcaaaattaagcatgcagtctccaggggctcttcaaaaatccgatggatagtggagcgggggatggtcaagccaaagggaaaagtggttgacctcggctgcggtcgtgggggatggagctactatatggctacgctaaagaacgtaaccgaagtgaaaggctacacaaagggcgggcccggacacgaggaacctatcccgatggccacttatggttggaatctggtcaaattgcattccggcgtggatgttttttacaagcccaccgagcaagtggacacactgctctgtgatattggggagagttctagcaacccaactatcgaagagggaagaacccttcgcgtcctgaagatggtggaaccttggttgtcatccaaacccgagttctgcattaaggtactgaatccttatatgccaacagtgatcgaagagctcgagaaattacagaggaagcacggcggtaacctggttcggtgtccccttagtagaaatagcacccacgaaatgtactgggtctctggggcatccggaaacattgtgtcaagcgtgaatactacgtcgaaaatgctgctaaaccgctttacaaccaggcatcgaaagcctacttatgagaaagacgtcgatctcggcgctggcacccggtctgttagtacagaaatcgagaagccagacatgacgataattgggagaaggctgcagcgcttgcaggaggaacacaaggagacctggcattacgatcaagaaaatccctaccgtacttgggcctatcacggatcctacgaggccccgagcacaggttcagcgtcctctatggtgaacggcgtagtgaaactgctcaccaagccttgggacgtcatcccaatggtgactcagcttgctatgacagataccacacccttcgggcagcagcgggtttttaaagaaaaggtggacactagaacccctcaaccaaaacccggaacgaggatggtcatgaccacaactgcaaattggctgtgggccttactgggcaagaagaaaaacccgcgcttgtgcacccgagaggagttcatcagcaaggtgcggagtaatgctgccattggtgcagtatttcaggaagagcaggggtggacatccgccagcgaagctgttaacgactctagattctgggagctcgtggataaagaaagggcgctgcaccaagagggaaagtgtgagtcatgcgtctataacatgatgggcaaacgcgaaaagaagctaggcgagtttgggagagccaaaggaagtcgggcaatatggtacatgtggcttggtgctaggttcctggaattcgaggccctcggctttctgaatgaagaccattggttcgggcgtgagaactcctggagcggagtggagggcgaaggtttgcaccgactggggtatatcctcgaggaaattgataagaaagacggagatcttatgtacgcagacgatactgccggctgggacacccgcatcacggaggatgacctgcagaatgaggaattaattacagagcagatggctcctcatcacaagatcctggccaaagcgatatttaagttgacctatcagaacaaggtggtcaaagttctcagacccactccacggggcgcagtgatggatatcatttctaggaaggaccaacgcgggtcgggacaggtaggtacatacggcctgaataccttcactaacatggaagtgcagctaatcagacagatggaggccgaaggggtcattacccaagatgacatgcagaatcctaaaggacttaaggagcgggtggagaaatggctgagggaatgcggcgttgaccgactcaagcgtatggctatctcaggtgatgactgtgtggtcaaacccctggatgagagatttgggacaagcttgttattcctgaacgacatgggaaaggtgcgcaaggatataccacagtgggaaccctccaaaggctggaagaattggcaggaggtacctttttgcagtcatcacttccacaaaatttttatgaaggacggccggtctctcgttgtgccatgtaggaaccaagatgaacttatcgggagagcccgcatcagccagggagcaggttggtccctgcgggagacggcttgcctaggcaaagcctacgctcagatgtggtcactgatgtatttccataggcgagacctcagattggccagtatggcaatttgttctgcggtcccgaccgagtggtttcccactagccggacaacctggtccatacacgcccatcaccagtggatgactacagaagatatgctgaaggtgtggaatagggtttggatcgaggacaaccctaatatgattgataagaccccagtgcactcatgggaagacatcccctaccttgggaaacgcgaggacctgtggtgcggaagcctcattggcttatcttcccgtgctacgtgggccaagaacatccatacagcaataacccaagtcagaaatctgatcggtaaagaagagtatgtggattacatgagtgtaatgaagcgatatagcgctccttcggagtccgaaggggtgttgtga

SEQ ID NO: 15777 - RNA, 9867 nt, synthetic construct
  misc_feature 1..9867: note = derived and/or modified CDS sequence (opt3) from DENV-4__KJ596658__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatcctgggcgataccatgtccggcagaatagggggacagacacatctagctatcatggccgttttcaagatgtctccgggttacgtgctgggcgtctttctcaggaaactgaccagccgtgagactgcacttatggtgattgggatggctatgacaaccacattgtcaatccctcacgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccaattacaatgaccctctggtatatgtggcaggtcaagactcaacgctccggggcactgtgggatgtgccgtcacctgccgcgacacagaaagctgccttgagtgagggagtttacagaatcatgcagaggggcttattcggcaagacccaggtgggggtcggaattcacatggaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggataaggaggaggacgtgcaagtactggccattgaaccaggaaagaaccccaaacatgtgcagacaaagcctggcctttttaaaaccctgacaggcgagatcggggctgttactttggacttcaagccaggaacctcaggtagtcccatcattaataggaaaggcaaggtcatagggctatacggaaacggcgtggtgacgaaaagcggtgattatgtctccgccatcacacaggcagaacgtattggggagcctgactacgaggtagatgaagacatctttcggaagaagagactgactattatggatctccacccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttatcagactccagccgtcaagtcggagcataccgggagagagatcgtggacctcatgtgccacgctacattcacgactcggctgcttagctcaaccagggttcccaattacaacctgattgtgatggatgaagcacactttacagacccttccagtgtcgccgcccgcggatacatctctacccgagtggagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtatggtttgtgccttctatcaaggccggcaatgacatagcaaactgcttgaggaagagcggtaaaaaggttattcagctaagtcgcaaaaccttcgataccgaataccccaagactaaactgacagactgggattttgtcgtgaccacagacatctccgagatgggggccaacttcagagctggcagggtgattgatccacggcgttgtctcaagccggtcatcttaactgacggacctgaacgcgttatactggcgggccccattccagtgacgcccgccagcgcagctcaacgaagagggaggatcggacggaatcctgcccaggaggatgaccagtatgtattctctggtgatccacttaagaacgacgaagatcatgcacactggaccgaggccaaaatgctgctcgacaatatctacacacccgagggcattatccctactttgtttgggccggaacgcgagaagacccaggctattgatggagaattcagactgaggggcgagcaacggaaaacatttgtggagctcatgcgaagaggtgacctgccagtctggctttcatataaggtggcctccgcggggataagttacaaagaccgcgaatggtgcttcaccggcgagaggaacaatcagatcctagaagagaacatggaagttgagatttggactcgggagggagaaaagaagaaactgcgtcccaagtggttggatgcaagagtgtatgccgaccctatggctttaaaagattttaaggagttcgccagcggcaggaaatcgatcacgctggacatcctcaccgaaattgcttctctgcccacatacctttccagccgcgcaaagctggccctcgataatatagtcatgttgcatactaccgagcgggggggacgagcttaccagcacgccctgaacgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggacaatcaattaatttatgtcatcctaacgatactgaccattatcggcctcattgcagccaacgaaatgggacttatcgagaaaactaagacagatttcggcttttaccaggtgaaaaccgagaccacaatactggacgtcgatttgaggccggctagcgcgtggactctgtatgccgtggcaacgaccatcctcacacccatgctgcgccacactattgaaaatacctcagctaaccttagtctcgccgccatcgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccattatcggaccaggcctgcaagcaaaagccacgagagaggctcagaagcgtacagcagccggtataatgaagaatcctaccgttgatggcattactgtgatcgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaattctcacactttgggaagggaaccctggacggttttggaacacgaccatcgcagtgagcactgccaatatattccgcggctcctatctggctggtgccgggttggcattttcactgattaaaaacgctcagacaccccgaagaggaaccggcactgccggtgagacactcggcgaaaagtggaaaaggcagctgaattctttagaccggaaggagttcgaagagtacaagcgcagtgggatccttgaggttgacagaaccgaagcgaaatcggccctgaaggatggaagcaaaattaagcatgcagtgtccaggggctcttcaaaaatccgatggatagtcgagcgggggatggtgaagccaaagggaaaagtcgtggacctcggctgcggtcgtgggggatggagctactatatggctacgctaaagaacgttaccgaagtaaaaggctacacaaagggcgggcccggacacgaggaacctatcccgatggccacttatggttggaatctggtgaaattgcattccggcgtcgatgtgttttacaagcccaccgagcaagttgacacactgctctgtgatattggggagagttctagcaacccaactatcgaagagggaagaacccttcgcgtgctgaagatggtcgaaccttggttgtcatccaaacccgagttctgcattaaggtgctgaatccttatatgccaacagtaatcgaagagctcgagaaattacagaggaagcacggcggtaacctggtgcggtgtccccttagtagaaatagcacccacgaaatgtactgggtttctggggcatccggaaacattgtctcaagcgtgaatactacgtcgaaaatgctgctaaaccgctttacaaccaggcatcgaaagcctacttatgagaaagacgtggatctcggcgctggcacccggtctgtcagtacagaaacggagaagccagacatgaccatcatagggagaaggctgcagcgcttgcaggaggaacacaaggagacttggcattacgatcaagaaaatccctaccgtacatgggcctatcacggatcctacgaggccccgagcaccggttcagcgtcctctatggttaacggcgtggtaaaactgctcactaagccttgggacgtgattccaatggtcacacagcttgctatgaccgatacaactcccttcgggcagcagcgggtgtttaaagaaaaggttgacaccagaacgcctcaaccaaaacccggaaccaggatggtgatgacaactaccgcaaattggctgtgggccttactgggcaagaagaaaaacccgcgcttgtgcacacgagaggagttcatcagcaaggtccggagtaatgctgccatcggtgcagtgtttcaggaagagcaggggtggacttccgccagcgaagctgtaaacgactctagattctgggagctcgttgataaagaaagggcgctgcaccaagagggaaagtgtgagtcatgcgtgtataacatgatgggcaaacgcgaaaagaagctaggcgagtttgggagagccaaaggaagtcgggcaatttggtacatgtggcttggtgctaggttcctggaattcgaggccctcggctttctgaatgaagaccattggttcgggcgtgagaactcctggagcggagtcgagggcgaaggtttgcaccgactggggtatatactcgaggaaatcgataagaaagacggagatcttatgtacgcagacgataccgccggctgggacacgcgcattacagaggatgacctgcagaatgaggaattaatcaccgagcagatggctcctcatcacaagattctggccaaagcgatctttaagttgacttatcagaacaaggtggtgaaagtcctcagacccacaccacggggcgcagttatggatataatctctaggaaggaccaacgcgggtcgggacaggtgggtacctacggcctgaatactttcaccaacatggaagtacagctaattagacagatggaggccgaaggggtgatcacacaagatgacatgcagaatcctaaaggacttaaggagcgggtcgagaaatggctgagggaatgcggcgtggaccgactcaagcgtatggctatttcaggtgatgactgtgttgtgaaacccctggatgagagatttgggacgagcttgttattcctgaacgacatgggaaaggtccgcaaggatatcccacagtgggaaccctccaaaggctggaagaattggcaggaggtgcctttttgcagtcatcacttccacaaaatatttatgaaggacggccggtctctcgtagttccatgtaggaaccaagatgaacttattgggagagcccgcatcagccagggagcaggttggtccctgcgggagaccgcttgcctaggcaaagcctacgctcagatgtggtcactgatgtatttccataggcgagacctcagattggccagtatggcaatctgttctgcggtgccgactgagtggtttcccacaagccggaccacttggtccattcacgcccatcaccagtggatgacaaccgaagatatgctgaaggtctggaatagggtgtggatagaggacaaccctaatatgatcgataagacgccagttcactcatgggaagacattccctaccttgggaaacgcgaggacctgtggtgcggaagcctcatcggcttatcttcccgtgctacatgggccaagaacattcataccgcaatcactcaagtgagaaatctgataggtaaagaagagtatgtcgattacatgcctgtgatgaagcgatatagtgctccaagcgagtcggaaggggtattgtga

SEQ ID NO: 15778 - RNA, 9867 nt, synthetic construct
  misc_feature 1..9867: note = derived and/or modified CDS sequence (opt3) from DENV-4__KJ596659__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaatcataaagagagaatggtgacattcaaggtcccccacgccaaaaggcaggatgtgaccgttctcggatctcaggaaggtgcgatgcactccgccctggcaggcgctactgaggtggactcaggggatggaaaccatatgtttgccggccaccttaagtgtaaggtacggatggaaaaactgcgaatcaagggtatgagctacacaatgtgcagtgggaaattctctatcgacaaggagatggctgagacgcaacatggcaccactgtcgtgaaagttaagtatgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtacatcgtcataggtgtgggcaactctgcgctgactttacactggtttaggaaagggtcctcaattggaaagatgttcgagagtacctatcggggcgcaaaacgcatggccatcctgggtgaaacggcttgggattttgggagcgtgggcggactattcacctccctcggcaaggccgtccatcaggtttttgggtctgtgtacacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcacacatggaccgaacaatataaatttcagcccgagtcaccagcccggcttgcaagtgcgatcctgaacgctcacaaggacggggtgtgtggaatccgaagcactacaagattggagaatgtaatgtggaaacagattaccaacgaactcaattacgtcctgtgggagggcggtcatgacttaactgtggtggccggggatgtcaagggagttctgaccaaaggcaagagggcactaacacctcccgcctccgacctcaagtattcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccaccgccttatgtctgctgccatcaaagatcagaaggcggtgcatgccgacatggggtactggattgaaagctccaaaaaccaaacttggcagatcgagcgagcttcattgatagaagtcaagacctgcctgtggccaaagacgcacacactctggagcaatggagtgctggagtctcagatgttaatcccgaaatcctatgcaggcccctttagtcagcacaactaccggcaaggttatgccacccagactgttgggccttggcatctgggaaagcttgagattgatttcggcgaatgcccaggtaccacagtgactatccaggagaactgtgaccaccgtggccccagcttgagaaccacaacggcttctgggaaactcgtcacccagtggtgctgtaggtcctgcactatgcctccactgcgctttctaggagaagatggctgttggtacgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcatatgatcttagcagtagtgataacgctctgcgcgattatcctggggggacttacttggatggacctgttgcgggccctcattatcctgggcgataccatgtccggcagaatagggggacagacacacctagctatcatggccgttttcaagatgtctccgggttatgtgctgggcgtctttctcaggaaactgaccagccgtgagactgcacttatggtgattgggatggctatgacaaccacattgtcaatccctcatgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacactgggtcgaaatcactgctcttattctgggggcgcaagccttgcccgtgtacctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctatgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccaattacaatgaccctctggtacatgtggcaggtcaagactcaacgctccggggcactgtgggatgtgccgtcacctgccgcgacacagaaagctgccttgagtgagggagtttatagaatcatgcagaggggcttattcggcaagacccaggtgggggtcggaattcacatggaaggtgtgttccatacgatgtggcacgttactcggggcagcgtgatctgtcatgagaccgggcgactggaaccctcttgggcagacgtcagaaatgatatgatatcctacggaggcggttggcgcctcggggacaaatgggataaggaggaggacgtgcaagtactggccattgaaccaggaaagaaccccaaacacgtgcagacaaagcctggcctttttaaaaccctgacaggcgagatcggggctgttactttggacttcaagccaggaacctcaggtagtcccatcattaataggaaaggcaaggtcatagggctatatggaaacggcgtggtgacgaaaagcggtgattacgtctccgccatcacacaggcagaacgtattggggagcctgactatgaggtagatgaagacatctttcggaagaagagactgactattatggatctccatccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttaccagactccagccgtcaagtcggagcacaccgggagagagatcgtggacctcatgtgccacgctacattcacgactcggctgcttagctcaaccagggttcccaattataacctgattgtgatggatgaagcacattttacagacccttccagtgtcgccgcccgcggatacatctctacccgagtggagatgggtgaagctgcggcaatattcatgactgccacaccgcccggcgctaccgatccatttcctcaaagcaattcccccattgaggacatcgaaagagagatcccagagcggtcatggaacacggggttcgattggattactgactaccagggaaaaacagtatggtttgtgccttctatcaaggccggcaatgacatagcaaactgcttgaggaagagcggtaaaaaggttattcagctaagtcgcaaaaccttcgataccgaatatcccaagactaaactgacagactgggattttgtcgtgaccacagacatctccgagatgggggccaacttcagagctggcagggtgattgatccacggcgttgtctcaagccggtcatcttaactgacggacctgaacgcgttatactggcgggccccattccagtgacgcccgccagcgcagctcaacgaagagggaggatcggacggaatcctgcccaggaggatgaccagtacgtattctctggtgatccacttaagaacgacgaagatcacgcacattggaccgaggccaaaatgctgctcgacaatatctatacacccgagggcattatccctactttgtttgggccggaacgcgagaagacccaggctattgatggagaattcagactgaggggcgagcaacggaaaacatttgtggagctcatgcgaagaggtgacctgccagtctggctttcatacaaggtggcctccgcggggataagttataaagaccgcgaatggtgcttcaccggcgagaggaacaatcagatcctagaagagaacatggaagttgagatttggactcgggagggagaaaagaagaaactgcgtcccaagtggttggatgcaagagtgtacgccgaccctatggctttaaaagattttaaggagttcgccagcggcaggaaatcgatcacgctggacatcctcaccgaaattgcttctctgcccacatatctttccagccgcgcaaagctggccctcgataatatagtcatgttgcacactaccgagcgggggggacgagcttaccagcacgccctgaacgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggacaatcaattaatttacgtcatcctaacgatactgaccattatcggcctcattgcagccaacgaaatgggacttatcgagaaaactaagacagatttcggcttttatcaggtgaaaaccgagaccacaatactggacgtcgatttgaggccggctagcgcgtggactctgtacgccgtggcaacgaccatcctcacacccatgctgcgccatactattgaaaatacctcagctaaccttagtctcgccgccatcgcaaatcaggctgccgttctgatggggttgggaaagggctggccactgcaccggatggacttaggtgtgcctctactggcgatggggtgttatagccaggtaaaccccacaaccctcactgcttcccttgtgatgctgttggtccattacgccattatcggaccaggcctgcaagcaaaagccacgagagaggctcagaagcgtacagcagccggtataatgaagaatcctaccgttgatggcattactgtgatcgacctcgaacccatctcttatgatccgaaattcgagaagcagctggggcaagtcatgcttttagtgctgtgcgcgggacagctcttgctgatgaggaccacatgggctttctgtgaggtactaactctggccaccggcccaattctcacactttgggaagggaaccctggacggttttggaacacgaccatcgcagtgagcactgccaatatattccgcggctcctacctggctggtgccgggttggcattttcactgattaaaaacgctcagacaccccgaagaggaaccggcactgccggtgagacactcggcgaaaagtggaaaaggcagctgaattctttagaccggaaggagttcgaagagtataagcgcagtgggatccttgaggttgacagaaccgaagcgaaatcggccctgaaggatggaagcaaaattaagcacgcagtgtccaggggctcttcaaaaatccgatggatagtcgagcgggggatggtgaagccaaagggaaaagtcgtggacctcggctgcggtcgtgggggatggagctactacatggctacgctaaagaacgttaccgaagtaaaaggctatacaaagggcgggcccggacatgaggaacctatcccgatggccacttacggttggaatctggtgaaattgcactccggcgtcgatgtgttttataagcccaccgagcaagttgacacactgctctgtgatattggggagagttctagcaacccaactatcgaagagggaagaacccttcgcgtgctgaagatggtcgaaccttggttgtcatccaaacccgagttctgcattaaggtgctgaatccttacatgccaacagtaatcgaagagctcgagaaattacagaggaagcacggcggtaacctggtgcggtgtccccttagtagaaatagcacccatgaaatgtattgggtttctggggcatccggaaacattgtctcaagcgtgaatactacgtcgaaaatgctgctaaaccgctttacaaccaggcaccgaaagcctacttacgagaaagacgtggatctcggcgctggcacccggtctgtcagtacagaaacggagaagccagacatgaccatcatagggagaaggctgcagcgcttgcaggaggaacataaggagacttggcactatgatcaagaaaatccctaccgtacatgggcctaccacggatcctatgaggccccgagcaccggttcagcgtcctctatggttaacggcgtggtaaaactgctcactaagccttgggacgtgattccaatggtcacacagcttgctatgaccgatacaactcccttcgggcagcagcgggtgtttaaagaaaaggttgacaccagaacgcctcaaccaaaacccggaaccaggatggtgatgacaactaccgcaaattggctgtgggccttactgggcaagaagaaaaacccgcgcttgtgcacacgagaggagttcatcagcaaggtccggagtaatgctgccatcggtgcagtgtttcaggaagagcaggggtggacttccgccagcgaagctgtaaacgactctagattctgggagctcgttgataaagaaagggcgctgcatcaagagggaaagtgtgagtcatgcgtgtacaacatgatgggcaaacgcgaaaagaagctaggcgagtttgggagagccaaaggaagtcgggcaatttggtatatgtggcttggtgctaggttcctggaattcgaggccctcggctttctgaatgaagaccactggttcgggcgtgagaactcctggagcggagtcgagggcgaaggtttgcatcgactggggtacatactcgaggaaatcgataagaaagacggagatcttatgtatgcagacgataccgccggctgggacacgcgcattacagaggatgacctgcagaatgaggaattaatcaccgagcagatggctcctcaccataagattctggccaaagcgatctttaagttgacttaccagaacaaggtggtgaaagtcctcagacccacaccacggggcgcagttatggatataatctctaggaaggaccaacgcgggtcgggacaggtgggtacctatggcctgaatactttcaccaacatggaagtacagctaattagacagatggaggccgaaggggtgatcacacaagatgacatgcagaatcctaaaggacttaaggagcgggtcgagaaatggctgagggaatgcggcgtggaccgactcaagcgtatggctatttcaggtgatgactgtgttgtgaaacccctggatgagagatttgggacgagcttgttattcctgaacgacatgggaaaggtccgcaaggatatcccacagtgggaaccctccaaaggctggaagaattggcaggaggtgcctttttgcagtcaccacttccataaaatatttatgaaggacggccggtctctcgtagttccatgtaggaaccaagatgaacttattgggagagcccgcatcagccagggagcaggttggtccctgcgggagaccgcttgcctaggcaaagcctacgctcagatgtggtcactgatgtacttccacaggcgagacctcagattggccagtatggcaatctgttctgcggtgccgactgagtggtttcccacaagccggaccacttggtccattcatgcccaccaccagtggatgacaaccgaagatatgctgaaggtctggaatagggtgtggatagaggacaaccctaatatgatcgataagacgccagttcattcatgggaagacattccctatcttgggaaacgcgaggacctgtggtgcggaagcctcatcggcttatcttcccgtgctacatgggccaagaacattcacaccgcaatcactcaagtgagaaatctgataggtaaagaagagtacgtcgattatatgcctgtgatgaagcgatacagtgctccaagcgagtcggaaggggtattgtga

SEQ ID NO: 15779 - RNA, 9867 nt, synthetic construct
  misc_feature 1..9867: note = derived and/or modified CDS sequence (opt3) from DENV-4__KJ596661__SS-prME
  source 1..9867: mol_type = other RNA
agcaccataaccctgctctgccttattcccactgtgatggccttccacctgtccacgcgggacggcgaacctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactgactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcaggattctgatcggttttcttgtattgtggattgggaccaattcaagaaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaaacttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctagggggccttacttggatggacctgttgcgggccctcattatgctgggcgataccatgtccggcagaatcgggggacagacacatctagctataatggccgttttcaagatgtctccgggttacgtgctgggcgtctttctcaggaaactgaccagccgtgagactgcacttatggtgatcgggatggctatgacaaccacattgtcaattcctcacgacctgatggagttaatcgacggaattagtctcggcctgatccttctgaagatagtaactcagttcgataacacccaagtgggtacgctagccctctccctgacatttattcgctctaccatgagcttggtcatggcatggcggactatcatggccgttctgttcgtggtgaccttaatcccactctgtagaacatcctgcctgcagaaacagtcacattgggtcgaaattactgctcttatcctgggggcgcaagccttgcccgtgtatctcatgaccctgatgaagggagcaagcaggcgaagttggcctctaaatgagggcattatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatataacgggaagttcccctatcattgaagtgaagcaggacgaggatggcagcttttctatccgggacgtcgaggaaacaaacatgattaccttgctcgtgaaactggccctaatcactgtaagcggtctgtacccccttgctataccaatcacaatgaccctctggtatatgtggcaggtcaagactcaacgctccggggcactgtgggatgtgccgagccctgccgcgacacagaaagctgccttgagtgagggagtttacagaattatgcagaggggcttattcggcaagacccaggtgggggtcggaatccacattgaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggataaggaggaggacgtgcaagtactggccattgaaccaggaaagaaccccaaacatgtgcagacaaagcctggcctttttaaaaccctgacaggcgagatcggggctgttactttggacttcaagccaggaacctcaggtagtcccatcattaataggaaaggcaaggtcatagggctatacggaaacggcgtggtgacgaaaagcggtgattatgtctccgccatcacacaggcagaacgtattggggagcctgactacgaggtagatgaagacatctttcggaagaagagactgactattatggatctccacccgggagctggcaaaaccaagaggatcctgccatctatagtgcgcgaggcccttaaacgaagattacggacactgatcctcgcgcccaccagggttgtggccgcagaaatggaggaggctttgcgcggcctgcctattcgttatcagactccagccgtcaagtcggagcataccgggagagagatcgtggacctcatgtgccacgctacattcacgactcggctgcttagctcaaccagggttcccaattacaacctgattgtgatggatgaagcacactttacagacccttccagtgtcgccgcccgcggatacatctctacccgagtggagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtatggtttgtgccttctatcaaggccggcaatgacatagcaaactgcttgaggaaatcaggtaaaaaggttattcagctaagtcgcaaaaccttcgataccgaataccccaagactaaactgacagactgggattttgtcgtgaccacagacatctccgagatgggggccaacttcagagctggcagggtgattgatccacggcgttgtctcaagccggtcatcttaactgacggacctgaacgcgttatactggcgggccccattccagtgacgcccgccagcgcagctcaacgaagagggaggatcggacggaatcctgcccaggaggatgaccagtatgtattctctggtgatccacttaagaacgacgaagatcatgcacactggaccgaggccaaaatgctgctcgacaatatctacacacccgagggcattatccctactttgtttgggccggaacgcgagaagacccaggctattgatggagagttcagactgaggggcgagcaacggaaaacatttgtggagctcatgcgaagaggtgacctgccagtctggctttcatataaggtggcctccgcggggataagttacaaagaccgcgaatggtgcttcaccggcgagaggaacaatcagatcctagaagagaacatggaagttgagatttggactcgggagggagaaaagaagaaactgcgtcccaagtggttggatgcaagagtgtatgccgaccctatggctttaaaagattttaaggagttcgccagcggcaggaaatcgatcacgctggacatcctcaccgaaattgcttctctgcccacatacctttccagccgcgcaaagctggccctcgataatatagtcatgttgcatactaccgagagagggggccgagcttaccagcacgccctgaacgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggacaatcaattaatttatgtcatcctaacgatactgaccattatcggcctcattgcagccaacgaaatgggacttatcgagaaaactaagacagatttcggcttttaccaggtgaaaaccgagaccacaatactggacgtcgatttgaggccggctagcgcgtggactctgtatgccgtggcaacgaccatcctcacacccatgctgcgccacactattgaaaatacctcagctaaccttagtctcgccgccatcgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccattatcggaccaggcctgcaagcaaaagccacgagagaggctcagaagcgtacagcagccggtataatgaagaatcctaccgttgatggcattactgtgatcgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaacactcacgctttgggaagggaaccctggacggttttggaacaccactattgcagtgagcacagccaatatcttccgcggctcctatctggctggtgccgggttggcattttcactgatcaagaacgctcagacaccccgaagaggaactggcacagccggtgagaccctcggcgaaaagtggaaaaggcagctaaattctttagaccggaaggagttcgaagagtacaagcgcagtgggattcttgaggttgacagaacggaagcgaaatcggccctgaaggatggaagcaaaatcaagcatgcagtgtccaggggatcttcaaaaattcgatggatcgtcgagcgggggatggtgaagccaaagggaaaagtcgtggacctcggctgcggtcgtgggggatggagctactatatggctaccctaaagaacgttacagaagtaaaaggctacactaagggcgggcccggacacgaggaacctataccgatggccacctatggttggaatctggtgaaattgcattccggcgtcgatgtgttttacaagcccacagagcaagttgacactctgctctgtgatatcggggagagttctagcaacccaaccattgaagagggaagaacacttcgcgtgctgaagatggtcgaaccttggttgtcatccaaacccgagttctgcatcaaggtgctgaatccttatatgccaaccgtaattgaagaactcgagaaattacagaggaagcacggcggtaacctggtgcggtgtccccttagtagaaatagcactcacgaaatgtactgggtttctggggcatccggaaacatcgtctcaagcgtgaatacgacatcgaaaatgctgctaaaccgctttaccactaggcatcgaaagcctacctatgagaaagacgtggatctcggcgctggcacacggtctgtcagtacggaaaccgagaagccagacatgactattatcgggagaaggctgcagcgcttgcaggaggaacacaaggagacatggcattacgatcaagaaaatccctaccgtacctgggcctatcacggatcctacgaggccccgagcactggttcagcgtcctctatggttaacggcgtggtaaaactgctcacaaagccttgggacgtgataccaatggtcacccagcttgctatgacagatactacccccttcgggcagcagcgggtgtttaaagaaaaggttgacacgagaacccctcaaccaaaacccggaacaaggatggtgatgactaccacagcaaattggctgtgggccttactgggcaagaagaaaaacccgcgcttgtgcactcgagaggagttcattagcaaggtccggagtaatgctgccatcggtgcagtgtttcaggaagaacaggggtggacctccgccagcgaagctgtaaacgactctagattctgggagctcgttgataaagaaagggcgctgcaccaagagggaaagtgtgagtcatgcgtgtataacatgatgggcaaacgcgaaaagaagctaggcgagtttgggagagccaaaggaagtcgggcaatctggtacatgtggcttggtgctaggttcctggagttcgaggccctcggctttctgaatgaagaccattggttcgggcgtgagaactcctggagcggagtcgagggcgaaggtttgcaccgactggggtatattctcgaggaaatagataagaaagacggagatcttatgtacgcagacgatacggccggctgggacacacgcatcaccgaggatgacctgcagaatgaggaattaattactgagcagatggctcctcatcacaagatcctggccaaagcgatttttaagttgacatatcagaacaaggtggtgaaagtcctcagacccaccccacggggcgcagttatggatatcatatctaggaaggaccaacgcgggtcgggacaggtgggtacttacggcctgaataccttcacaaacatggaagtacagctaatcagacagatggaggccgaaggggtgattacgcaagatgacatgcagaatcctaaaggacttaaggagcgggtcgagaaatggctgagggaatgcggcgtggaccgactcaagcgtatggctatctcaggtgatgactgtgttgtgaaacccctggatgagagatttgggaccagcttgttattcctgaacgacatgggaaaggcccgcaaggatattccacagtgggaaccctccaaaggctggaagaattggcaggaggtccctttttgcagtcatcacttccacaaaatctttatgaaggacggccggtctctcgtggtaccatgtaggaaccaagatgaacttatagggagagcacgcattagccagggagctggttggtccctgcgggagactgcctgcctaggcaaggcttacgcccagatgtggtcactgatgtatttccataggcgagacctcagattggcaagtatggcgatctgttctgccgttccgacagagtggtttcccaccagccggactacatggtccatccacgctcatcaccagtggatgaccacggaagatatgctgaaggtgtggaatagggtctggattgaggacaaccctaatatgatagataagacaccagtgcactcatgggaagacatcccctaccttgggaaacgcgaggacctgtggtgcggaagcctcattggcttatcttcccgtgccacctgggcaaagaacatccatactgctattacccaagttagaaatctgatcggtaaagaagagtatgtggattacatgcctgtcatgaagcgatatagtgccccaagcgagtcggaaggggtgttgtga

SEQ ID NO: 15780 - RNA, 9867 nt, synthetic construct
  misc_feature 1..9867: note = derived and/or modified CDS sequence (opt3) from DENV-4__KJ596663__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatcctgggcgataccatgtccggcagaatagggggacagacacatctagctatcatggccgttttcaagatgtctccgggttacgtgctgggcgtctttctcaggaaactgaccagccgtgagactgcacttatggtgattgggatggctatgacaaccacattgtcaatccctcacgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccaattacaatgaccctctggtatatgtggcaggtcaagactcaacgctccggggcactgtgggatgtgccgtcacctgccgcgacacagaaagctgccttgagtgagggagtttacagaatcatgcagaggggcttattcggcaagacccaggtgggggtcggaattcacatggaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggataaggaggaggacgtgcaagtactggccattgaaccaggaaagaaccccaaacatgtgcagacaaagcctggcctttttaaaaccctgacaggcgagatcggggctgttactttggacttcaagccaggaacctcaggtagtcccatcattaataggaaaggcaaggtcatagggctatacggaaacggcgtggtgacgaaaagcggtgattatgtctccgccatcacacaggcagaacgtattggggagcctgactacgaggtagatgaagacatctttcggaagaagagactgactattatggatctccacccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttatcagactccagccgtcaagtcggagcataccgggagagagatcgtggacctcatgtgccacgctacattcacgactcggctgcttagctcaaccagggttcccaattacaacctgattgtgatggatgaagcacactttacagacccttccagtgtcgccgcccgcggatacatctctacccgagtggagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtatggtttgtgccttctatcaaggccggcaatgacatagcaaactgcttgaggaagagcggtaaaaaggttattcagctaagtcgcaaaaccttcgataccgaataccccaagactaaactgacagactgggattttgtcgtgaccacagacatctccgagatgggggccaacttcagagctggcagggtgattgatccacggcgttgtctcaagccggtcatcttaactgacggacctgaacgcgttatactggcgggccccattccagtgacgcccgccagcgcagctcaacgaagagggaggatcggacggaatcctgcccaggaggatgaccagtatgtattctctggtgatccacttaagaacgacgaagatcatgcacactggaccgaggccaaaatgctgctcgacaatatctacacacccgagggcattatccctactttgtttgggccggaacgcgagaagacccaggctattgatggagaattcagactgaggggcgagcaacggaaaacatttgtggagctcatgcgaagaggtgacctgccagtctggctttcatataaggtggcctccgcggggataagttacaaagaccgcgaatggtgcttcaccggcgagaggaacaatcagatcctagaagagaacatggaagttgagatttggactcgggagggagaaaagaagaaactgcgtcccaagtggttggatgcaagagtgtatgccgaccctatggctttaaaagattttaaggagttcgccagcggcaggaaatcgatcacgctggacatcctcaccgaaattgcttctctgcccacatacctttccagccgcgcaaagctggccctcgataatatagtcatgttgcatactaccgagcgggggggacgagcttaccagcacgccctgaacgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggacaatcaattaatttatgtcatcctaacgatactgaccattatcggcctcattgcagccaacgaaatgggacttatcgagaaaactaagacagatttcggcttttaccaggtgaaaaccgagaccacaatactggacgtcgatttgaggccggctagcgcgtggactctgtatgccgtggcaacgaccatcctcacacccatgctgcgccacactattgaaaatacctcagctaaccttagtctcgccgccatcgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccattatcggaccaggcctgcaagcaaaagccacgagagaggctcagaagcgtacagcagccggtataatgaagaatcctaccgttgatggcattactgtgatcgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaattctcacactttgggaagggaaccctggacggttttggaacacgaccatcgcagtgagcactgccaatatattccgcggctcctatctggctggtgccgggttggcattttcactgattaaaaacgctcagacaccccgaagaggaaccggcactgccggtgagacactcggcgaaaagtggaaaaggcagctgaattctttagaccggaaggagttcgaagagtacaagcgcagtgggatccttgaggttgacagaaccgaagcgaaatcggccctgaaggatggaagcaaaattaagcatgcagtgtccaggggctcttcaaaaatccgatggatagtcgagcgggggatggtgaagccaaagggaaaagtcgtggacctcggctgcggtcgtgggggatggagctactatatggctacgctaaagaacgttaccgaagtaaaaggctacacaaagggcgggcccggacacgaggaacctatcccgatggccacttatggttggaatctggtgaaattgcattccggcgtcgatgtgttttacaagcccaccgagcaagttgacacactgctctgtgatattggggagagttctagcaacccaactatcgaagagggaagaacccttcgcgtgctgaagatggtcgaaccttggttgtcatccaaacccgagttctgcattaaggtgctgaatccttatatgccaacagtaatcgaagagctcgagaaattacagaggaagcacggcggtaacctggtgcggtgtccccttagtagaaatagcacccacgaaatgtactgggtttctggggcatccggaaacattgtctcaagcgtgaatactacgtcgaaaatgctgctaaaccgctttacaaccaggcatcgaaagcctacttatgagaaagacgtggatctcggcgctggcacccggtctgtcagtacagaaacggagaagccagacatgaccatcatagggagaaggctgcagcgcttgcaggaggaacacaaggagacttggcattacgatcaagaaaatccctaccgtacatgggcctatcacggatcctacgaggccccgagcaccggttcagcgtcctctatggttaacggcgtggtaaaactgctcactaagccttgggacgtgattccaatggtcacacagcttgctatgaccgatacaactcccttcgggcagcagcgggtgtttaaagaaaaggttgacaccagaacgcctcaaccaaaacccggaaccaggatggtgatgacaactaccgcaaattggctgtgggccttactgggcaagaagaaaaacccgcgcttgtgcacacgagaggagttcatcagcaaggtccggagtaatgctgccatcggtgcagtgtttcaggaagagcaggggtggacttccgccagcgaagctgtaaacgactctagattctgggagctcgttgataaagaaagggcgctgcaccaagagggaaagtgtgagtcatgcgtgtataacatgatgggcaaacgcgaaaagaagctaggcgagtttgggagagccaaaggaagtcgggcaatttggtacatgtggcttggtgctaggttcctggaattcgaggccctcggctttctgaatgaagaccattggttcgggcgtgagaactcctggagcggagtcgagggcgaaggtttgcaccgactggggtatatactcgaggaaatcgataagaaagacggagatcttatgtacgcagacgataccgccggctgggacacgcgcattacagaggatgacctgcagaatgaggaattaatcaccgagcagatggctcctcatcacaagactctggccaaagcgatttttaagttgacatatcagaacaaggtggtgaaagtcctcagacccaccccacggggcgcagttatggatatcatatctaggaaggaccaacgcgggtcgggacaggtgggtacttacggcctgaataccttcacaaacatggaagtacagctaatcagacagatggaggccgaaggggtgattacgcaagatgacatgcagaatcctaaaggacttaaggagcgggtcgagaaatggctgagggaatgcggcgtggaccgactcaagcgtatggctatctcaggtgatgactgtgttgtgaaacccctggatgagagatttgggaccagcttgttattcctgaacgacatgggaaaggtccgcaaggatattccacagtgggaaccctccaaaggctggaagaattggcaggaggtgcctttttgcagtcatcacttccacaaaatctttatgaaggacggccggtctctcgtagttccatgtaggaaccaagatgaacttatagggagagcccgcattagccagggagcaggttggtccctgcgggagactgcttgcctaggcaaagcctacgctcagatgtggtcactgatgtatttccataggcgagacctcagattggccagtatggcaatctgttctgcggtgccgacagagtggtttcccaccagccggactacatggtccatccacgcccatcaccagtggatgaccacggaagatatgctgaaggtctggaatagggtgtggattgaggacaaccctaatatgatagataagacaccagttcactcatgggaagacatcccctaccttgggaaacgcgaggacctgtggtgcggaagcctcattggcttatcttcccgtgctacctgggccaagaacatccatactgcaattacccaagtgagaaatctgatcggtaaagaagagtatgtcgattacatgcctgtgatgaagcgatatagtgctccaagcgagtcggaaggggtattgtga

SEQ ID NO: 15781 - RNA, 9867 nt, synthetic construct
  misc_feature 1..9867: note = derived and/or modified CDS sequence (opt3) from DENV-4__KJ596664__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatgctgggcgataccatgtccggcagaatcgggggacagacacatctagctataatcgccgttttcaagatgtctccgggttacgtgctgggcgtctttctcaggaaactgaccagccgtgagactgcacttatggtgattgggatggctatgacaaccacattgtcaatccctcacgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccaattacaatgaccctctggtatatgtggcaggtcaagactcaacgctccggggcactgtgggatgtgccgtcacctgccgcgacacagaaagctgccttgagtgagggagtttacagaatcatgcagaggggcttattcggcaagacccaggtgggggtcggaattcacatggaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggataaggaggaggacgtgcaagtactggccattgaaccaggaaagaaccccaaacatgtgcagacaaagcctggcctttttaaaaccctgacaggcgagatcggggctgttactttggacttcaagccaggaacctcaggtagtcccatcattaataggaaaggcaaggtcatagggctatacggaaacggcgtggtgacgaaaagcggtgattatgtctccgccatcacacaggcagaacgtattggggagcctgactacgaggtagatgaagacatctttcggaagaagagactgactattatggatctccacccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttatcagactccagccgtcaagtcggagcataccgggagagagatcgtggacctcatgtgccacgctacattcacgactcggctgcttagctcaaccagggttcccaattacaacctgattgtgatggatgaagcacactttacagacccttccagtgtcgccgcccgcggatacatctctacccgagtggagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtatggtttgtgccttctatcaaggccggcaatgacatagcaaactgcttgaggaagagcggtaaaaaggttattcagctaagtcgcaaaaccttcgataccgaataccccaagactaaactgacagactgggattttgtcgtgaccacagacatctccgagatgggggccaacttcagagctggcagggtgattgatccacggcgttgtctcaagccggtcatcttaactgacggacctgaacgcgttatactggcgggccccattccagtgacgcccgccagcgcagctcaacgaagagggaggatcggacggaatcctgcccaggaggatgaccagtatgtattctctggtgatccacttaagaacgacgaagatcatgcacactggaccgaggccaaaatgctgctcgacaatatctacacacccgagggcattatccctactttgtttgggccggaacgcgagaagacccaggctattgatggagaattcagactgaggggcgagcaacggaaaacatttgtggagctcatgcgaagaggtgacctgccagtctggctttcatataaggtggcctccgcggggataagttacaaagaccgcgaatggtgcttcaccggcgagaggaacaatcagatcctagaagagaacatggaagttgagatttggactcgggagggagaaaagaagaaactgcgtcccaagtggttggatgcaagagtgtatgccgaccctatggctttaaaagattttaaggagttcgccagcggcaggaaatcgatcacgctggacatcctcaccgaaattgcttctctgcccacatacctttccagccgcgcaaagctggccctcgataatatagtcatgttgcatactaccgagcgggggggacgagcttaccagcacgccctgaacgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggacaatcaattaatttatgtcatcctaacgatactgaccattatcggcctcattgcagccaacgaaatgggacttatcgagaaaactaagacagatttcggcttttaccaggtgaaaaccgagaccacaatactggacgtcgatttgaggccggctagcgcgtggactctgtatgccgtggcaacgaccatcctcacacccatgctgcgccacactattgaaaatacctcagctaaccttagtctcgccgccatcgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccattatcggaccaggcctgcaagcaaaagccacgagagaggctcagaagcgtacagcagccggtataatgaagaatcctaccgttgatggcattactgtgatcgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaattctcacactttgggaagggaaccctggacggttttggaacacgaccatcgcagtgagcactgccaatatattccgcggctcctatctggctggtgccgggttggcattttcactgattaaaaacgctcagacaccccgaagaggaaccggcactgccggtgagacactcggcgaaaagtggaaaaggcagctgaattctttagaccggaaggagttcgaagagtacaagcgcagtgggatccttgaggttgacagaaccgaagcgaaatcggccctgaaggatggaagcaaaattaagcatgcagtgtccaggggctcttcaaaaatccgatggatagtcgagcgggggatggtgaagccaaagggaaaagtcgtggacctcggctgcggtcgtgggggatggagctactatatggctacgctaaagaacgttaccgaagtaaaaggctacacaaagggcgggcccggacacgaggaacctatcccgatggccacttatggttggaatctggtgaaattgcattccggcgtcgatgtgttttacaagcccaccgagcaagttgacacactgctctgtgatattggggagagttctagcaacccaactatcgaagagggaagaacccttcgcgtgctgaagatggtcgaaccttggttgtcatccaaacccgagttctgcattaaggtgctgaatccttatatgccaacagtaatcgaagagctcgagaaattacagaggaagcacggcggtaacctggtgcggtgtccccttagtagaaatagcacccacgaaatgtactgggtttctggggcatccggaaacattgtctcaagcgtgaatactacgtcgaaaatgctgctaaaccgctttacaaccaggcatcgaaagcctacttatgagaaagacgtggatctcggcgctggcacccggtctgtcagtacagaaatcgagaagccagacatgacgataattgggagaaggctgcagcgcttgcaggaggaacacaaggagacctggcattacgatcaagaaaatccctaccgtacttgggcctatcacggatcctacgaggccccgagcacaggttcagcgtcctctatggttaacggcgtggtaaaactgctcaccaagccttgggacgtgatcccaatggtcactcagcttgctatgacagataccacacccttcgggcagcagcgggtgtttaaagaaaaggttgacactagaacccctcaaccaaaacccggaacgaggatggtgatgaccacaactgcaaattggctgtgggccttactgggcaagaagaaaaacccgcgcttgtgcacccgagaggagttcatcagcaaggtccggagtaatgctgccattggtgcagtgtttcaggaagagcaggggtggacatccgccagcgaagctgtaaacgactctagattctgggagctcgttgataaagaaagggcgctgcaccaagagggaaagtgtgagtcatgcgtgtataacatgatgggcaaacgcgaaaagaagctaggcgagtttgggagagccaaaggaagtcgggcaatatggtacatgtggcttggtgctaggttcctggaattcgaggccctcggctttctgaatgaagaccattggttcgggcgtgagaactcctggagcggagtcgagggcgaaggtttgcaccgactggggtatatcctcgaggaaattgataagaaagacggagatcttatgtacgcagacgatactgccggctgggacacccgcatcacggaggatgacctgcagaatgaggaattaattacagagcagatggctcctcatcacaagatcctggccaaagcgatatttaagttgacctatcagaacaaggtggtgaaagtcctcagacccactccacggggcgcagttatggatatcatttctaggaaggaccaacgcgggtcgggacaggtgggtacatacggcctgaataccttcactaacatggaagtacagctaatcagacagatggaggccgaaggggtgattacccaagatgacatgcagaatcctaaaggacttaaggagcgggtcgagaaatggctgagggaatgcggcgtggaccgactcaagcgtatggctatctcaggtgatgactgtgttgtgaaacccctggatgagagatttgggacaagcttgttattcctgaacgacatgggaaaggtccgcaaggatataccacagtgggaaccctccaaaggctggaagaattggcaggaggtgcctttttgcagtcatcacttccacaaaatttttatgaaggacggccggtctctcgtagttccatgtaggaaccaagatgaacttatcgggagagcccgcatcagccagggagcaggttggaatctgcgggagacggcttgcctaggcaaagcctacgctcagatgtggtccctgatgtatttccataggcgagacctcagattggcctcaatggcaatttgtagtgcggtgccgaccgagtggtttcccacttctcggacaacctggagcatacacgcccatcaccagtggatgactacagaagatatgctgaaggtctggaacagggtgtggatcgaggacaatcctaacatgattgataagaccccagttcactcctgggaagacatcccctaccttgggaaacgcgaggacctgtggtgcggatcactcattggcttaagctctcgtgctacgtgggccaagaatatccatacagcaataacccaagtgagaaacctgatcggtaaagaagagtatgtcgattacatgtccgtgatgaagcgatatagtgctcctagcgagtcggaaggggtattgtga

SEQ ID NO: 15782 - RNA, 9867 nt, synthetic construct
  misc_feature 1..9867: note = derived and/or modified CDS sequence (opt3) from DENV-4__KJ596665__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccggtctcaagtactcttggaaaacgtggggcaaggctaaaatattcaccccagaagcccgcaactcgacttttctgatcgacgggcccgatacaagcgagtgccctaatgaacggagagcatggaactccttcgaggtggaggactacggattcggcatgtttaccacaaatatttggatgaagttcagggaagggtcaagtgaggtatgtgatcatcgccttatgtctgctgccatcaaagaccagaaggcggtgcacgccgatatgggatattggattgaaagctccaaaaaccaaacttggcagatcgagcgagcttcattgatagaagtcaagacctgcctgtggccaaagacgcatacactctggagcaatggcgtgctggagtctcagatgttaatcccgaaatcctacgcaggtccctttagtcagcacaactatcggcaagggtacgccacccagactgttggaccttggcacctgggcaagcttgagattgacttcggtgaatgcccaggcaccacagtgactatccaggagaactgtgatcatcgtgggcccagcttgagaaccacaacggcttctggaaaactcgtcacccagtggtgctgtaggtcctgcactatgcctccactgcgctttctaggcgaagacgggtgttggtatggaatggagattcggcccctgtcagagaaggaagagaatatggtgaaaagtcaagttacagccggccagggtaccagcgaaactttctcgatggggctcctgtgccttacattgtttgtggaggaatgtctgagaaggcgagtcacccgcaagcacatgatcttagcagtagtgataacgctctgcgcgattatcctgggaggccttacttggatggatctgttgcgggccctcattatcctgggcgacaccatgtccgggagaataggaggtcagacacatctagctatcatggccgttttcaagatgtctccgggctacgtgctgggggtctttctcaggaaactgaccagccgtgagactgcacttatggtgattggaatggctatgacaaccacattgtcaatccctcacgatctgatggagttaattgacggcatcagtctcggtctgatacttctgaagattgtaactcagttcgacaacacccaagtggggacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggagcgcaagccttgcccgtgtatctcatgaccctgatgaagggcgcaagcaggcgaagttggcctctaaatgagggcataatggctgttgggctggtatctcttctcggatccgccctgttgaaaaacgatgtgcccctggccggtccaatggtcgctggcgggttactcctggcagcctacgtgatgagcggatcgtcagcggacctttctctggaaaaggctgccaatgttcagtgggatgagatggcagacatcacgggcagttcccctattatcgaagtgaagcaggatgaggacggtagcttttctattcgggatgtcgaggaaacaaacatgatcaccttgctcgtgaaactggccctaataactgtaagcgggctgtacccccttgctatcccaattacaatgaccctctggtatatgtggcaggtcaagactcaacgctccggagcactgtgggacgtgccgtcacctgccgcgacacagaaagctgccttgagtgagggcgtttacagaatcatgcagaggggcttattcgggaagacccaggtgggagtcggtattcacatggaaggcgtgttccacacgatgtggcatgttactcgggggagcgtgatctgtcacgagaccggacgactggaaccctcttgggcagatgtcagaaatgacatgatatcctatggcggtgggtggcgcctcggagataaatgggacaaggaggaggatgtgcaagtactggccattgaaccaggcaagaaccccaaacatgtgcagacaaagcctggcctttttaaaaccctgacaggggagatcggagctgttactttggacttcaagccaggtacctcaggcagtcccatcattaataggaaagggaaggtcataggactatacggcaacggtgtggtgacgaaaagcggggactatgtctccgccatcacacaggcagaacgtattggagagcctgattacgaggtagacgaagatatctttcggaagaagagactgactattatggacctccacccgggcgctggcaaaaccaagaggatcctgccatctatagtgcgcgaggcccttaaacgaagattacggacactgatcctcgcgcccaccagggttgtggccgcagaaatggaggaagctttgcgcgggctgcctattcgttatcagactccagccgtcaagtcggagcataccggaagagagatcgtggatctcatgtgccacgctacattcacgactcggctgcttagctcaaccagggttcccaattacaacctgattgtgatggacgaagcacactttacagatccttccagtgtcgccgcccgcggttacatctctacccgagtggagatgggcgaagctgcggcaatattcatgactgccacaccgcccggggctaccgacccatttcctcaaagcaattcccccattgaggatatcgaaagagagatcccagagcggtcatggaacacgggattcgactggattactgattatcagggcaaaacagtatggtttgtgccttctatcaaggccggtaatgacatagcaaactgcttgaggaagagcgggaaaaaggttattcagctaagtcgcaaaaccttcgacaccgaataccccaagactaaactgacagattgggactttgtcgtgaccacagatatctccgagatgggcgccaacttcagagctggaagggtgattgacccacggcgttgtctcaagccggtcatcttaactgatggccctgaacgcgttatactggcggggcccattccagtgacgcccgccagcgcagctcaacgaagaggaaggatcggtcggaatcctgcccaggaggacgatcagtatgtattctctggcgacccacttaagaacgatgaagaccatgcacactggaccgaggccaaaatgctgctcgataatatctacacacccgaggggattatccctactttgtttggaccggaacgcgagaagacccaggctattgacggcgaattcagactgaggggtgagcaacggaaaacatttgtggagctcatgcgaagaggggatctgccagtctggctttcatataaggtggcctccgcgggcataagttacaaagaccgcgaatggtgcttcaccggagagaggaacaatcagatcctagaagagaacatggaagttgagatttggactcgggagggcgaaaagaagaaactgcgtcccaagtggttggacgcaagagtgtatgccgatcctatggctttaaaagactttaaggagttcgccagcgggaggaaatcgatcacgctggatatcctcaccgaaattgcttctctgcccacatacctttccagccgcgcaaagctggccctcgacaatatagtcatgttgcatactaccgagcggggaggtcgagcttaccagcacgccctgaacgaactaccagagtcactggagacactcatgcttgtagcactgttaggcgcgatgaccgccgggatctttttgttctttatgcagggaaagggcattggtaaactgagtatggggctcatcactattgctgtggcctctggcctgctttgggttgcagaaatccaacctcagtggatagctgcctccatcattctggagttctttctcatggtgttgctgatccccgaaccagagaagcagagaacacctcaggataatcaattaatttatgtcatcctaacgatactgaccattatcggactcattgcagccaacgaaatgggccttatcgagaaaactaagacagacttcgggttttaccaggtgaaaaccgagaccacaatactggatgtcgacttgaggccggctagcgcgtggactctgtatgccgtggcaacgaccatcctcacacccatgctgcgccacactattgaaaatacctcagctaaccttagtctcgccgccatcgcaaatcaggctgccgttctgatgggattgggcaagggttggccactgcatcggatggatttaggggtgcctctactggcgatgggatgttacagccaggtaaaccccacaaccctcactgcttcccttgtgatgctgttggtccactatgccattatcggcccaggtctgcaagcaaaagccacgagagaggctcagaagcgtacagcagccggcataatgaagaatcctaccgttgacgggattactgtgatcgatctcgaacccatctcttacgacccgaaattcgagaagcagctgggacaagtcatgcttttagtgctgtgcgcgggccagctcttgctgatgaggaccacatgggctttctgtgaggtactaactctggccaccgggccaattctcacactttgggaaggaaaccctggccggttttggaacacgaccatcgcagtgagcactgccaatatattccgcggttcctatctggctggggccggattggcattttcactgattaaaaacgctcagacaccccgaagaggcaccggtactgccggcgagacactcggggaaaagtggaaaaggcagctgaattctttagatcggaaggagttcgaagagtacaagcgcagtggaatccttgaggttgacagaaccgaagcgaaatcggccctgaaggacggcagcaaaattaagcatgcagtgtccagggggtcttcaaaaatccgatggatagtcgagcggggaatggtgaagccaaagggcaaagtcgtggatctcggttgcgggcgtggaggctggagctactatatggctacgctaaagaacgttaccgaagtaaaaggctacacaaaggggggacccggtcacgaggaacctatcccgatggccacttatggctggaatctggtgaaattgcattccggggtcgacgtgttttacaagcccaccgagcaagttgatacactgctctgtgacattggagagagttctagcaacccaactatcgaagagggcagaacccttcgcgtgctgaagatggtcgaaccttggttgtcatccaaacccgagttctgcattaaggtgctgaatccttatatgccaacagtaatcgaagagctcgagaaattacagaggaagcacggtgggaacctggtgcggtgtccccttagtagaaatagcacccacgaaatgtactgggtttctggagcatccggcaacattgtctcaagcgtgaatactacgtcgaaaatgctgctaaaccgctttacaaccaggcatcgaaagcctacttatgagaaagatgtggacctcggcgctgggacccggtctgtcagtacagaaacggagaagccagatatgaccatcataggaagaaggctgcagcgcttgcaggaggaacacaaggagacttggcattacgaccaagaaaatccctaccgtacatgggcctatcacggttcctacgaggccccgagcaccggctcagcgtcctctatggttaacggggtggtaaaactgctcactaagccttgggatgtgattccaatggtcacacagcttgctatgaccgacacaactcccttcggacagcagcgggtgtttaaagaaaaggttgataccagaacgcctcaaccaaaacccggcaccaggatggtgatgacaactaccgcaaattggctgtgggccttactgggtaagaagaaaaacccgcgcttgtgcacacgagaggagttcatcagcaaggtccggagtaatgctgccatcggggcagtgtttcaggaagagcagggatggacttccgccagcgaagctgtaaacgactctagattctgggagctcgttgacaaagaaagggcgctgcaccaagagggcaagtgtgagtcatgcgtgtataacatgatgggcaaacgcgaaaagaagctaggggagtttggaagagccaaaggtagtcgggcaatttggtacatgtggcttggcgctaggttcctggaattcgaggccctcgggtttctgaatgaagatcattggttcggacgtgagaactcctggagcggcgtcgagggtgaagggttgcaccgactgggatatatactcgaggaaatcgacaagaaagatggcgaccttatgtacgcagatgacaccgccggctgggatacgcgcattacagaggacgatctgcagaatgaggaattaatcaccgagcagatggctcctcatcacaagattctggccaaagcgatctttaagttgacttatcagaacaaggtggtgaaagtcctcagacccacaccacggggggcagttatggacataatctctaggaaggatcaacgcggatcgggtcaggtgggcacctacgggctgaatactttcaccaacatggaagtacagctaattagacagatggaggccgaaggagtgatcacacaagacgatatgcagaatcctaaaggccttaaggagcgggtcgagaaatggctgagggaatgcggtgtggaccgactcaagcgtatggctatttcaggggacgattgtgttgtgaaacccctggacgagagatttggaacgagcttgttattcctgaacgatatgggcaaggtccgcaaggacatcccacagtgggaaccctccaaaggctggaagaattggcaggaggtgcctttttgcagtcatcacttccacaaaatatttatgaaggatgggcggtctctcgtagttccatgtaggaaccaagacgaacttattggaagagcccgcatcagccagggtgcaggctggtccctgcgggagaccgcttgcctagggaaagcctacgctcagatgtggtcactgatgtatttccataggcgagatctcagattggccagtatggcaatctgttctgcggtgccgactgagtggtttcccacaagccggaccacttggtccattcacgcccatcaccagtggatgacaaccgaaaatatgctgaaggtctggaacagggtgtggatagaggacaatcctaacatgatcgataagacgccagttcactcatgggaagacattccctaccttggaaaacgcgaggatctgtggtgcggcagcctcatcggtttatcttcccgtgctacatgggccaagaatattcataccgcaatcactcaagtgagaaacctgatagggaaagaagagtatgtcgactacatgcctgtgatgaagcgatatagtgctccaagcgagtcggaaggagtattgtga

SEQ ID NO: 15783 - RNA, 9867 nt, synthetic construct
  misc_feature 1..9867: note = derived and/or modified CDS sequence (opt3) from DENV-4__KJ596668__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatcctgggcgataccatgtccggcagaatagggggacagacacatctagctatcatggccgttttcaagatgtctccgggttacgtgctgggcgtctttctcaggaaactgaccagccgtgagactgcacttatggtgattgggatggctatgacaaccacattgtcaatccctcacgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccagtcacaatgaccctctggtatatgtggcaggtgaagactcaacgctccggggcactgtgggatgttccgtcacctgccgcgacacagaaagctgccttgagtgagggagtgtacagaattatgcagaggggcttattcggcaagacccaggtcggggtgggaatccacatggaaggtgttttccacacgatgtggcatgtgactcggggcagcgtcatttgtcacgagaccgggcgactggaaccctcttgggcagacgtgagaaatgatatgatctcctatggaggcggttggcgcctcggggacaaatgggataaggaggaggacgtacaagtgctggccatagaaccaggaaagaaccccaaacatgttcagacaaagcctggcctttttaaaaccctgacaggcgagattggggctgtcactttggacttcaagccaggaacctcaggtagtcccatcatcaataggaaaggcaaggtgattgggctatacggaaacggcgtggtcacgaaaagcggtgattatgtatccgccataacacaggcagaacgtatcggggagcctgactacgaggtggatgaagacatttttcggaagaagagactgactatcatggatctccacccgggagctggcaaaaccaagaggattctgccatctatcgttcgcgaggcccttaaacgaagattacggacactgatactcgcgcccaccagggtggtcgccgcagaaatggaggaagctttgcgcggcctgcctatccgttatcagactccagccgtgaagtcggagcataccgggagagagattgttgacctcatgtgccacgctacattcacgactcggctgcttagctcaaccagggtgcccaattacaacctgatcgtcatggatgaagcacactttacagacccttccagtgtggccgcccgcggatacatttctacccgagtagagatgggtgaagctgcggcaatcttcatgactgccacaccgcccggcgctaccgatccatttcctcaaagcaattcccccatagaggacattgaaagagagatcccagagcggtcatggaacacggggttcgattggatcactgactatcagggaaaaacagtgtggtttgttccttctattaaggccggcaatgacatcgcaaactgcttgaggaagagcggtaaaaaggtcatacagctaagtcgcaaaaccttcgataccgaataccccaagactaaactgacagactgggattttgtggtgaccacagacatttccgagatgggggccaacttcagagctggcagggtcatcgatccacggcgttgtctcaagccggttattttaactgacggacctgaacgcgtgatcctggcgggccccataccagtaacgcccgccagcgcagctcaacgaagagggaggattggacggaatcctgcccaggaggatgaccagtatgtgttctctggtgatccacttaagaacgacgaagatcatgcacactggaccgaggccaaaatgctgctcgacaatatctacacacccgagggcatcattcctactttgtttgggccggaacgcgagaagacccaggctatcgatggagaattcagactgaggggcgagcaacggaaaacatttgtcgagctcatgcgaagaggtgacctgccagtgtggctttcatataaggttgcctccgcggggattagttacaaagaccgcgaatggtgcttcaccggcgagaggaacaatcagatactagaagagaacatggaagtggagatctggactcgggagggagaaaagaagaaactgcgtcccaagtggttggatgcaagagtctatgccgaccctatggctttaaaagattttaaggagttcgccagcggcaggaaatcgattacgctggacatcctcaccgaaatcgcttctctgcccacatacctttccagccgcgcaaagctggccctcgataatattgtaatgttgcatactaccgagcgggggggacgagcttaccagcacgccctgaacgaactaccagagtcactggagacactcatgcttgtggcactgttaggtgcgatgaccgccggcatatttttgttctttatgcaggggaagggaatcggcaaactgagtatgggtctcattactatcgctgttgcctctgggctgctttgggtggcagaaattcaacctcagtggatcgctgcctccataatcctggagttctttctcatggtcttgctgattcccgaaccagagaagcagagaacacctcaggacaatcaattaatctatgtgattctaacgatcctgaccataattggcctcatcgcagccaacgaaatgggacttattgagaaaactaagacagatttcggcttttaccaggtcaaaaccgagaccacaatcctggacgtggatttgaggccggctagcgcgtggactctgtatgccgttgcaacgaccatactcacacccatgctgcgccacactatcgaaaatacctcagctaaccttagtctcgccgccattgcaaatcaggctgccgtgctgatggggttgggaaagggctggccactgcatcggatggacttaggtgtacctctactggcgatggggtgttacagccaggtgaaccccacaaccctcactgcttcccttgtcatgctgttggttcactatgccatcattggaccaggcctgcaagcaaaagccacgagagaggctcagaagcgtacagcagccggtatcatgaagaatcctaccgtggatggcataactgtcattgacctcgaacccatctcttacgatccgaaattcgagaagcagctggggcaagtgatgcttttagtactgtgcgcgggacagctcttgctgatgaggaccacatgggctttctgtgaggtgctaactctggccaccggcccaatcctcacactttgggaagggaaccctggacggttttggaacacgaccattgcagttagcactgccaatatcttccgcggctcctatctggctggtgccgggttggcattttcactgataaaaaacgctcagacaccccgaagaggaaccggcactgccggtgagacactcggcgaaaagtggaaaaggcagctgaattctttagaccggaaggagttcgaagagtacaagcgcagtgggattcttgaggtggacagaaccgaagcgaaatcggccctgaaggatggaagcaaaatcaagcatgcagtctccaggggctcttcaaaaattcgatggatcgtggagcgggggatggtcaagccaaagggaaaagtggttgacctcggctgcggtcgtgggggatggagctactatatggctacgctaaagaacgtaaccgaagtgaaaggctacacaaagggcgggcccggacacgaggaacctataccgatggccacttatggttggaatctggtcaaattgcattccggcgtggatgttttttacaagcccaccgagcaagtggacacactgctctgtgatatcggggagagttctagcaacccaactattgaagagggaagaacccttcgcgtcctgaagatggtggaaccttggttgtcatccaaacccgagttctgcatcaaggtactgaatccttatatgccaacagtgattgaagagctcgagaaattacagaggaagcacggcggtaacctggttcggtgtccccttagtagaaatagcacccacgaaatgtactgggtctctggggcatccggaaacatcgtgtcaagcgtgaatactacgtcgaaaatgctgctaaaccgctttacaaccaggcatcgaaagcctacttatgagaaagacgtcgatctcggcgctggcacccggtctgttagtacagaaacggagaagccagacatgaccattatcgggagaaggctgcagcgcttgcaggaggaacacaaggagacttggcattacgatcaagaaaatccctaccgtacatgggcctatcacggatcctacgaggccccgagcaccggttcagcgtcctctatggtgaacggcgtagtgaaactgctcactaagccttgggacgtcataccaatggtgacacagcttgctatgaccgatacaactcccttcgggcagcagcgggtttttaaagaaaaggtggacaccagaacgcctcaaccaaaacccggaaccaggatggtcatgacaactaccgcaaattggctgtgggccttactgggcaagaagaaaaacccgcgcttgtgcacacgagaggagttcattagcaaggtgcggagtaatgctgccatcggtgcagtatttcaggaagagcaggggtggacttccgccagcgaagctgttaacgactctagattctgggagctcgtggataaagaaagggcgctgcaccaagagggaaagtgtgagtcatgcgtctataacatgatgggcaaacgcgaaaagaagctaggcgagtttgggagagccaaaggaagtcgggcaatctggtacatgtggcttggtgctaggttcctggaattcgaggccctcggctttctgaatgaagaccattggttcgggcgtgagaactcctggagcggagtggagggcgaaggtttgcaccgactggggtatattctcgaggaaatagataagaaagacggagatcttatgtacgcagacgataccgccggctgggacacgcgcatcacagaggatgacctgcagaatgaggaattaattaccgagcagatggctcctcatcacaagatcctggccaaagcgatttttaagttgacttatcagaacaaggtggtcaaagttctcagacccacaccacggggcgcagtgatggatatcatatctaggaaggaccaacgcgggtcgggacaggtaggtacctacggcctgaatactttcaccaacatggaagtgcagctaatcagacagatggaggccgaaggggtcattacacaagatgacatgcagaatcctaaaggacttaaggagcgggtggagaaatggctgagggaatacggcgttgaccgactcaagcgtatggctatctcaggtgatgactgcgtggtcaaacccctggatgagagatttgggacgagcttgttattcctgaacgacatgggaaaggtgcgcaaggatattccacagtgggaaccctccaaaggctggaagaattggcaggaggtacctttttgtagtcatcacttccacaaaatctttatgaaggacggccggtctctcgttgtgccatgcaggaaccaagatgaacttatagggagagcccgcattagccagggagcaggttggtccctgcgggagaccgcttgtctaggcaaagcctatgctcagatgtggtcactgatgtacttccataggcgagacctcagattggccagtatggcaatctgctctgcggtcccgactgagtggtttcccacaagccggaccacttggtccatccacgcccatcaccagtggatgacaaccgaagatatgctgaaggtgtggaatagggtttggattgaggacaaccctaatatgatagataagacgccagtgcactcatgggaagacatcccctatcttgggaaacgcgaggacctgtggtgtggaagcctcattggcttatcttcccgtgctacatgggccaagaacatccataccgcaattactcaagtcagaaatctgatcggtaaagaagagtacgtggattatatgcctgtaatgaagcgatacagtgctccaagcgagtcggaaggggtgttgtga

SEQ ID NO: 15784 - RNA, 9867 nt, synthetic construct
  misc_feature 1..9867: note = derived and/or modified CDS sequence (opt3) from DENV-4__KJ596670__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattgttctggggggacttacttggatggacctgttgcgggccctcatcatgctgggcgataccatgtccggcagaattgggggacagacacatctagctatcatagccgtgttcaagatgtctccgggttacgtcctgggcgtgtttctcaggaaactgaccagccgtgagactgcacttatggtaatcgggatggctatgacaaccacattgtcaattcctcacgacctgatggagttaatcgacggaattagtctcggcctgatccttctgaagatagtgactcagttcgataacacccaagtcggtacgctagccctctccctgacatttattcgctctaccatgagcttggttatggcatggcggactatcatggccgtgctgttcgtggtcaccttaatcccactctgtagaacatcctgcctgcagaaacagtcacattgggtggaaattactgctcttatcctgggggcgcaagccttgcccgtttatctcatgaccctgatgaagggagcaagcaggcgaagttggcctctaaatgagggcattatggctgtaggcctggtgtctcttctcgggtccgccctgttgaaaaacgacgtccccctggccggaccaatggtggctggtggcttactcctggcagcctacgttatgagcgggtcgtcagcggatctttctctggaaaaggctgccaatgtgcagtgggacgagatggcagatataacgggaagttcccctatcattgaagtcaagcaggacgaggatggcagcttttctatccgggacgtggaggaaacaaacatgattaccttgctcgtaaaactggccctaatcactgtcagcggtctgtacccccttgctataccaatcacaatgaccctctggtatatgtggcaggtgaagactcaacgctccggggcactgtgggatgttccgtcacctgccgcgacacagaaagctgccttgagtgagggagtgtacagaattatgcagaggggcttattcggcaagacccagatcggggtcggaattcacatggaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggataaggaggaggacgtgcaagtactggccattgaaccaggaaagaaccccaaacatgtgcagacaaagcctggcctttttaaaaccctgacaggcgagatcggggctgttactttggacttcaagccaggaacctcaggtagtcccatcattaataggaaaggcaaggtcatagggctatacggaaacggcgtggtgacgaaaagcggtgattatgtctccgccatcacacaggcagaacgtattggggagcctgactacgaggtagatgaagacatctttcggaagaagagactgactattatggatctccacccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttatcagactccagccgtcaagtcggagcataccgggagagagatcgtggacctcatgtgccacgctacattcacgactcggctgcttagctcaaccagggttcccaattacaacctgattgtgatggatgaagcacactttacagacccttccagtgtcgccgcccgcggatacatctctacccgagtggagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtatggtttgtgccttctatcaaggccggcaatgacatagcaaactgcttgaggaagagcggtaaaaaggttattcagctaagtcgcaaaaccttcgataccgaataccccaagactaaactgacagactgggattttgtcgtgaccacagacatctccgagatgggggccaacttcagagctggcagggtgattgatccacggcgttgtctcaagccggtcatcttaactgacggacctgaacgcgttatactggcgggccccattccagtgacgcccgccagcgcagctcaacgaagagggaggatcggacggaatcctgcccaggaggatgaccagtatgtattctctggtgatccacttaagaacgacgaagatcatgcacactggaccgaggccaaaatgctgctcgacaatatctacacacccgagggcattatccctactttgtttgggccggaacgcgagaagacccaggctattgatggagaattcagactgaggggcgagcaacggaaaacatttgtggagctcatgcgaagaggtgacctgccagtctggctttcatataaggtggcctccgcggggataagttacaaagaccgcgaatggtgcttcaccggcgagaggaacaatcagatcctagaagagaacatggaagttgagatttggactcgggagggagaaaagaagaaactgcgtcccaagtggttggatgcaagagtgtatgccgaccctatggctttaaaagattttaaggagttcgccagcggcaggaaatcgatcacgctggacatcctcaccgaaattgcttctctgcccacatacctttccagccgcgcaaagctggccctcgataatatagtcatgttgcatactaccgagcgggggggacgagcttaccagcacgccctgaacgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggacaatcaattaatttatgtcatcctaacgatactgaccattatcggcctcattgcagccaacgaaatgggacttatcgagaaaactaagacagatttcggcttttaccaggtgaaaaccgagaccacaatactggacgtcgatttgaggccggctagcgcgtggactctgtatgccgtggcaacgaccatcctcacacccatgctgcgccacactattgaaaatacctcagctaaccttagtctcgccgccatcgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccattatcggaccaggcctgcaagcaaaagccacgagagaggctcagaagcgtacagcagccggtataatgaagaatcctaccgttgatggcattactgtgatcgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaattctcacactttgggaagggaaccctggacggttttggaacacgaccatcgcagtgagcactgccaatatattccgcggctcctatctggctggtgccgggttggcattttcactgattaaaaacgctcagacaccccgaagaggaaccggcactgccggtgagacactcggcgaaaagtggaaaaggcagctgaattctttagaccggaaggagttcgaagagtacaagcgcagtgggatccttgaggttgacagaaccgaagcgaaatcggccctgaaggatggaagcaaaattaagcatgcagtgtccaggggctcttcaaaaatccgatggatagtcgagcgggggatggtgaagccaaagggaaaagtcgtggacctcggctgcggtcgtgggggatggagctactatatggctacgctaaagaacgttaccgaagtaaaaggctacacaaagggcgggcccggacacgaggaacctatcccgatggccacttatggttggaatctggtgaaattgcattccggcgtcgatgtgttttacaagcccaccgagcaagttgacacactgctctgtgatattggggagagttctagcaacccaactatcgaagagggaagaacccttcgcgtgctgaagatggtcgaaccttggttgtcatccaaacccgagttctgcattaaggtgctgaatccttatatgccaacagtaatcgaagagctcgagaaattacagaggaagcacggcggtaacctggtgcggtgtccccttagtagaaatagcacccacgaaatgtactgggtttctggggcatccggaaacattgtctcaagcgtgaatactacgtcgaaaatgctgctaaaccgctttacaaccaggcatcgaaagcctacttatgagaaagacgtggatctcggcgctggcacccggtctgtcagtacagaaatcgagaagccagacatgacgataattgggagaaggctgcagcgcttgcaggaggaacacaaggagacctggcattacgatcaagaaaatccctaccgtacttgggcctatcacggatcctacgaggccccgagcacaggttcagcgtcctctatggttaacggcgtggtaaaactgctcaccaagccttgggacgtgatcccaatggtcactcagcttgctatgacagataccacacccttcgggcagcagcgggtgtttaaagaaaaggttgacactagaacccctcaaccaaaacccggaacgaggatggtgatgaccacaactgcaaattggctgtgggccttactgggcaagaagaaaaacccgcgcttgtgcacccgagaggagttcatcagcaaggtccggagtaatgctgccattggtgcagtgtttcaggaagagcaggggtggacatccgccagcgaagctgtaaacgactctagattctgggagctcgttgataaagaaagggcgctgcaccaagagggaaagtgtgagtcatgcgtgtataacatgatgggcaaacgcgaaaagaagctaggcgagtttgggagagccaaaggaagtcgggcaatatggtacatgtggcttggtgctaggttcctggaattcgaggccctcggctttctgaatgaagaccattggttcgggcgtgagaactcctggagcggagtcgagggcgaaggtttgcaccgactggggtatatcctcgaggaaattgataagaaagacggagatcttatgtacgcagacgatactgccggctgggacacccgcatcacggaggatgacctgcagaatgaggaattaattacagagcagatggctcctcatcacaagatcctggccaaagcgatatttaagttgacctatcagaacaaggtggtgaaagtcctcagacccactccacggggcgcagttatggatatcatttctaggaaggaccaacgcgggtcgggacaggtgggtacatacggcctgaataccttcactaacatggaagtacagctaatcagacagatggaggccgaaggggtgattacccaagatgacatgcagaatcctaaaggacttaaggagcgggtcgagaaatggctgagggaatgcggcgtggaccgactcaagcgtatggctatctcaggtgatgactgtgttgtgaaacccctggatgagagatttgggacaagcttgttattcctgaacgacatgggaaaggtccgcaaggatataccacagtgggaaccctccaaaggctggaagaattggcaggaggtgcctttttgcagtcatcacttccacaaaatttttatgaaggacggccggtctctcgtagttccatgtaggaaccaagatgaacttatcgggagagcccgcatcagccagggagcaggttggtccctgcgggagacggcttgcctaggcaaagcctacgctcagatgtggtcactgatgtatttccataggcgagacctcagattggccagtatggcaatttgttctgcggtgccgaccgagtggtttcccactagccggacaacctggtccatacacgcccatcaccagtggatgactacagaagatatgctgaaggtctggaatagggtgtggatcgaggacaaccctaatatgattgataagaccccagttcactcatgggaagacatcccctaccttgggaaacgcgaggacctgtggtgcggaagcctcattggcttatcttcccgtgctacgtgggccaagaacatccatacagcaataacccaagtgagaaatctgatcggtaaagaagagtatgtcgattacatgagtgtgatgaagcgatatagcgctccttcggagtccgaaggggtattgtga

SEQ ID NO: 15785 - RNA, 9867 nt, synthetic construct
  misc_feature 1..9867: note = derived and/or modified CDS sequence (opt3) from DENV-4__KJ596671__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatgctgggcgataccatgtccggcagaatcgggggacagacacatctagctataatcgccgttttcaagatgtctccgggttacgtgctgggcgtctttctcaggaaactgaccagccgtgagactgcacttatggtgattgggatggctatgacaaccacattgtcaatccctcacgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccaattacaatgaccctctggtatatgtggcaggtcaagactcaacgctccggggcactgtgggatgtgccgtcacctgccgcgacacagaaagctgccttgagtgagggagtttacagaatcatgcagaggggcttattcggcaagacccaggtgggggtcggaattcacatggaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggataaggaggaggacgtgcaagtactggccattgaaccaggaaagaaccccaaacatgtgcagacaaagcctggcctttttaaaaccctgacaggcgagatcggggctgttactttggacttcaagccaggaacctcaggtagtcccatcattaataggaaaggcaaggtcatagggctatacggaaacggcgtggtgacgaaaagcggtgattatgtctccgccatcacacaggcagaacgtattggggagcctgactacgaggtagatgaagacatctttcggaagaagagactgactattatggatctccacccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttatcagactccagccgtcaagtcggagcataccgggagagagatcgtggacctcatgtgccacgctacattcacgactcggctgcttagctcaaccagggttcccaattacaacctgattgtgatggatgaagcacactttacagacccttccagtgtcgccgcccgcggatacatctctacccgagtggagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtatggtttgtgccttctatcaaggccggcaatgacatagcaaactgcttgaggaagagcggtaaaaaggttattcagctaagtcgcaaaaccttcgataccgaataccccaagactaaactgacagactgggattttgtcgtgaccacagacatctccgagatgggggccaacttcagagctggcagggtgattgatccacggcgttgtctcaagccggtcatcttaactgacggacctgaacgcgttatactggcgggccccattccagtgacgcccgccagcgcagctcaacgaagagggaggatcggacggaatcctgcccaggaggatgaccagtatgtattctctggtgatccacttaagaacgacgaagatcatgcacactggaccgaggccaaaatgctgctcgacaatatctacacacccgagggcattatccctactttgtttgggccggaacgcgagaagacccaggctattgatggagaattcagactgaggggcgagcaacggaaaacatttgtggagctcatgcgaagaggtgacctgccagtctggctttcatataaggtggcctccgcggggataagttacaaagaccgcgaatggtgcttcaccggcgagaggaacaatcagatcctagaagagaacatggaagttgagatttggactcgggagggagaaaagaagaaactgcgtcccaagtggttggatgcaagagtgtatgccgaccctatggctttaaaagattttaaggagttcgccagcggcaggaaatcgatcacgctggacatcctcaccgaaattgcttctctgcccacatacctttccagccgcgcaaagctggccctcgataatatagtcatgttgcatactaccgagcgggggggacgagcttaccagcacgccctgaacgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggacaatcaattaatttatgtcatcctaacgatactgaccattatcggcctcattgcagccaacgaaatgggacttatcgagaaaactaagacagatttcggcttttaccaggtgaaaaccgagaccacaatactggacgtcgatttgaggccggctagcgcgtggactctgtatgccgtggcaacgaccatcctcacacccatgctgcgccacactattgaaaatacctcagctaaccttagtctcgccgccatcgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccattatcggaccaggcctgcaagcaaaagccacgagagaggctcagaagcgtacagcagccggtataatgaagaatcctaccgttgatggcattactgtgatcgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaattctcacactttgggaagggaaccctggacggttttggaacacgaccatcgcagtgagcactgccaatatattccgcggctcctatctggctggtgccgggttggcattttcactgattaaaaacgctcagacaccccgaagaggaaccggcactgccggtgagacactcggcgaaaagtggaaaaggcagctgaattctttagaccggaaggagttcgaagagtacaagcgcagtgggatccttgaggttgacagaaccgaagcgaaatcggccctgaaggatggaagcaaaattaagcatgcagtgtccaggggctcttcaaaaatccgatggatagtcgagcgggggatggtgaagccaaagggaaaagtcgtggacctcggctgcggtcgtgggggatggagctactatatggctacgctaaagaacgttaccgaagtaaaaggctacacaaagggcgggcccggacacgaggaacctatcccgatggccacttatggttggaatctggtgaaattgcattccggcgtcgatgtgttttacaagcccaccgagcaagttgacacactgctctgtgatattggggagagttctagcaacccaactatcgaagagggaagaacccttcgcgtgctgaagatggtcgaaccttggttgtcatccaaacccgagttctgcattaaggtgctgaatccttatatgccaacagtaatcgaagagctcgagaaattacagaggaagcacggcggtaacctggtgcggtgtccccttagtagaaatagcacccacgaaatgtactgggtttctggggcatccggaaacattgtctcaagcgtgaatactacgtcgaaaatgctgctaaaccgctttacaaccaggcatcgaaagcctacttatgagaaagacgtggatctcggcgctggcacccggtctgtcagtacagaaatcgagaagccagacatgacgataattgggagaaggctgcagcgcttgcaggaggaacacaaggagacctggcattacgatcaagaaaatccctaccgtacttgggcctatcacggatcctacgaggccccgagcacaggttcagcgtcctctatggttaacggcgtggtaaaactgctcaccaagccttgggacgtgatcccaatggtcactcagcttgctatgacagataccacacccttcgggcagcagcgggtgtttaaagaaaaggttgacactagaacccctcaaccaaaacccggaacgaggatggtgatgaccacaactgcaaattggctgtgggccttactgggcaagaagaaaaacccgcgcttgtgcacccgagaggagttcatcagcaaggtccggagtaatgctgccattggtgcagtgtttcaggaagagcaggggtggacatccgccagcgaagctgtaaacgactctagattctgggagctcgttgataaagaaagggcgctgcaccaagagggaaagtgtgagtcatgcgtgtataacatgatgggcaaacgcgaaaagaagctaggcgagtttgggagagccaaaggaagtcgggcaatatggtacatgtggcttggtgctaggttcctggaattcgaggccctcggctttctgaatgaagaccattggttcgggcgtgagaactcctggagcggagtcgagggcgaaggtttgcaccgactggggtatatcctcgaggaaattgataagaaagacggagatcttatgtacgcagacgatactgccggctgggacacccgcatcacggaggatgacctgcagaatgaggaattaattacagagcagatggctcctcatcacaagatcctggccaaagcgatatttaagttgacctatcagaacaaggtggtgaaagtcctcagacccactccacggggcgcagttatggatatcatttctaggaaggaccaacgcgggtcgggacaggtgggtacatacggcctgaataccttcactaacatggaagtacagctaatcagacagatggaggccgaaggggtgattacccaagatgacatgcagaatcctaaaggacttaaggagcgggtcgagaaatggctgagggaatgcggcgtggaccgactcaagcgtatggctatctcaggtgatgactgtgttgtgaaacccctggatgagagatttgggacaagcttgttattcctgaacgacatgggaaaggtccgcaaggatataccacagtgggaaccctccaaaggctggaagaattggcaggaggtgcctttttgcagtcatcacttccacaaaatttttatgaaggacggccggtctctcgtagttccatgtaggaaccaagatgaacttatcgggagagcccgcatcagccagggagcaggttggtccctgcgggagacggcttgcctaggcaaagcctacgctcagatgtggtcactgatgtatttccataggcgagacctcagattggccagtatggcaatttgttctgcggtgccgaccgagtggtttcccactagccggacaacctggtccatacacgcccatcaccagtggatgactacagaagatatgctgaaggtctggaatagggtgtggatcgaggacaaccctaatatgattgataagaccccagttcactcatgggaagacatcccctaccttgggaaacgcgaggacctgtggtgcggaagcctcattggcttatcttcccgtgctacgtgggccaagaacatccatacagcaataacccaagtgagaaatctgatcggtaaagaagagtatgtcgattacatgagtgtgatgaagcgatatagcgctccttcggagtccgaaggggtattgtga

SEQ ID NO: 15786 - RNA, 9867 nt, synthetic construct
  misc_feature 1..9867: note = derived and/or modified CDS sequence (opt3) from DENV-4__KJ579241__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaagatcccccatgccaaaaggcaggatgtcaccgtgctcggatctcaggaaggtgcgatgcactccgccctggcaggcgctactgaggttgactcaggggatggaaaccacatgtttgccggccatcttaagtgtaaggtgcggatggaaaaactgcgaatcaagggtatgagctatacaatgtgcagtgggaaattctctattgacaaggagatggctgagacgcaacacggcaccactgtagtcaaagtgaagtacgaaggagccggcgcaccttgtaaggttccaatagagatccgcgatgtgaataaagaaaaggtcgtggggagagtaatttccgccacacccttggctgagaacaccaacagcgtgacaaatatcgagctcgaaccgcctttcggagactcgtatatagttattggtgtcggcaactctgcgctgactttacattggtttaggaaagggtcctcaatcggaaagatgttcgagagtacctaccggggcgcaaaacgcatggccatcctgggtgaaacggcttgggattttgggagcgtgggcggactattcacctccctcggcaaggccgtgcaccaggtctttgggtctgtttatacaactatgttcggaggcgtgagctggatgattagaatcctgattggttttcttgtgttgtggatagggaccaattcaaggaacacaagtatggcaatgacttgcatcgccgtaggaggcattaccctgttcctcggttttacggtccaggctgacatgggctgtgtggtttcctggagcgggcgtgagctgaagtgcggatctggcatcttcgtggtcgataatgtgcatacatggaccgaacaatacaaatttcagcccgagtcaccagcccggcttgcaagtgcgatcctgaacgctcacaaggacggggtttgtggaattcgaagcactacaagattggagaatgtgatgtggaaacagataaccaacgaactcaattatgtactgtgggagggcggtcacgacttaactgtcgtggccggggatgtgaagggagtcctgaccaaaggcaagagggcactaacacctcccgcctccgacctcaagtactcttggaaaacgtggggtaaggctaaaatcttcaccccagaagcccgcaactcgacttttctgattgatggccccgacacaagcgagtgccctaatgaacggagagcatggaactccttcgaggttgaggattacgggttcggaatgtttaccacaaatatctggatgaagttcagggaaggctcaagtgaggtgtgtgaccatcgccttatgtctgctgccattaaagatcagaaggcggtacacgccgacatggggtattggatcgaaagctccaaaaaccaaacttggcagatagagcgagcttcattgatcgaagtgaagacctgcctgtggccaaagacgcatacactctggagcaatggagtcctggagtctcagatgttaattccgaaatcctacgcaggcccctttagtcagcacaactatcggcaaggttacgccacccagactgtggggccttggcacctgggaaagcttgagatcgatttcggcgaatgcccaggtaccacagttactattcaggagaactgtgaccatcgtggccccagcttgagaaccacaacggcttctgggaaactcgtgacccagtggtgctgtaggtcctgcactatgcctccactgcgctttctaggagaagatggctgttggtatgggatggagatccggcccctgtcagagaaggaagagaatatggtcaaaagtcaagtgacagccggacagggcaccagcgaaactttctcgatgggtctcctgtgccttacattgtttgttgaggaatgtctgagaaggcgagtgacccgcaagcacatgatattagcagtcgtaattacgctctgcgcgatcattctggggggacttacttggatggacctgttgcgggccctcatcatactgggcgataccatgtccggcagaatcgggggacagacacatctagctattatggccgtgttcaagatgtctccgggttacgttctgggcgtgtttctcaggaaactgaccagccgtgagactgcacttatggtcatcgggatggctatgacaaccacattgtcaattcctcacgacctgatggagttaatcgacggaataagtctcggcctgattcttctgaagatcgtgactcagttcgataacacccaagtaggtacgctagccctctccctgacatttatccgctctaccatgagcttggtgatggcatggcggactattatggccgtcctgttcgttgtgaccttaatcccactctgtagaacatcctgcctgcagaaacagtcacattgggtggaaattactgctcttatactgggggcgcaagccttgcccgtctatctcatgaccctgatgaagggagcaagcaggcgaagttggcctctaaatgagggcatcatggctgtgggcctggtttctcttctcgggtccgccctgttgaaaaacgacgtacccctggccggaccaatggtggctggtggcttactcctggcagcctacgtcatgagcgggtcgtcagcggatctttctctggaaaaggctgccaatgtgcagtgggacgagatggcagatattacgggaagttcccctatcattgaagttaagcaggacgaggatggcagcttttctatccgggacgtggaggaaacaaacatgataaccttgctcgtcaaactggccctaatcactgtgagcggtctgtacccccttgctattccaatcacaatgaccctctggtatatgtggcaggtaaagactcaacgctccggggcactgtgggatgtcccgtcacctgccgcgacacagaaagctgccttgagtgagggagtgtacagaattatgcagaggggcttattcggcaagacccaggttggggtgggaatccacatggaaggtgtcttccacacgatgtggcatgtgactcggggcagcgttatatgtcacgagaccgggcgactggaaccctcttgggcagacgtgagaaatgatatgatttcctatggaggcggttggcgcctcggggacaaatgggataaggaggaggacgtccaagtgctggccatcgaaccaggaaagaaccccaaacatgtacagacaaagcctggcctttttaaaaccctgacaggcgagatcggggctgtgactttggacttcaagccaggaacctcaggtagtcccattataaataggaaaggcaaggttatcgggctatacggaaacggcgtcgtgacgaaaagcggtgattatgtgtccgccattacacaggcagaacgtatcggggagcctgactacgaggtcgatgaagacatttttcggaagaagagactgactatcatggatctccacccgggagctggcaaaaccaagaggatactgccatctatcgtacgcgaggcccttaaacgaagattacggacactgattctcgcgcccaccagggtggttgccgcagaaatggaggaagctttgcgcggcctgcctatccgttatcagactccagccgtgaagtcggagcataccgggagagagattgtcgacctcatgtgccacgctacattcacgactcggctgcttagctcaaccagggtgcccaattacaacctgatcgttatggatgaagcacactttacagacccttccagtgtggccgcccgcggatacatatctacccgagtcgagatgggtgaagctgcggcaattttcatgactgccacaccgcccggcgctaccgatccatttcctcaaagcaattcccccatcgaggacatcgaaagagagattccagagcggtcatggaacacggggttcgattggatcactgactatcagggaaaaacagtgtggtttgtaccttctataaaggccggcaatgacattgcaaactgcttgaggaagagcggtaaaaaggtgatccagctaagtcgcaaaaccttcgataccgaataccccaagactaaactgacagactgggattttgttgtcaccacagacatttccgagatgggggccaacttcagagctggcagggtgatcgatccacggcgttgtctcaagccggtgatattaactgacggacctgaacgcgtcattctggcgggccccatcccagttacgcccgccagcgcagctcaacgaagagggaggatcggacggaatcctgcccaggaggatgaccagtatgtgttctctggtgatccacttaagaacgacgaagatcatgcacactggaccgaggccaaaatgctgctcgacaatatttacacacccgagggcatcattcctactttgtttgggccggaacgcgagaagacccaggctatagatggagaattcagactgaggggcgagcaacggaaaacatttgtagagctcatgcgaagaggtgacctgccagtgtggctttcatataaggtcgcctccgcggggatcagttacaaagaccgcgaatggtgcttcaccggcgagaggaacaatcagattctagaagagaacatggaagtggagatctggactcgggagggagaaaagaagaaactgcgtcccaagtggttggatgcaagagtttatgccgaccctatggctttaaaagattttaaggagttcgccagcggcaggaaatcgatcacgctggacattctcaccgaaatagcttctctgcccacatacctttccagccgcgcaaagctggccctcgataatatcgtgatgttgcatactaccgagcgggggggacgagcttaccagcacgccctgaacgaactaccagagtcactggagacactcatgcttgtcgcactgttaggtgcgatgaccgccggcatttttttgttctttatgcaggggaagggaatcggcaaactgagtatgggtctcattactatcgctgtagcctctgggctgctttgggtggcagaaatacaacctcagtggatcgctgcctccattatcctggagttctttctcatggttttgctgattcccgaaccagagaagcagagaacacctcaggacaatcaattaatctatgtgatactaacgattctgaccatcattggcctcatcgcagccaacgaaatgggacttatagagaaaactaagacagatttcggcttttaccaggtcaaaaccgagaccacaatcctggacgtggatttgaggccggctagcgcgtggactctgtatgccgtcgcaacgaccattctcacacccatgctgcgccacactatcgaaaatacctcagctaaccttagtctcgccgccattgcaaatcaggctgccgtgctgatggggttgggaaagggctggccactgcatcggatggacttaggtgttcctctactggcgatggggtgttacagccaggtgaaccccacaaccctcactgcttcccttgtaatgctgttggtgcactatgccatcataggaccaggcctgcaagcaaaagccacgagagaggctcagaagcgtacagcagccggtattatgaagaatcctaccgtcgatggcatcactgttatcgacctcgaacccatttcttacgatccgaaattcgagaagcagctggggcaagtgatgcttttagtcctgtgcgcgggacagctcttgctgatgaggaccacatgggctttctgtgaggtgctaactctggccaccggcccaatcctcacactttgggaagggaaccctggacggttttggaacacgaccatagcagtaagcactgccaatattttccgcggctcctatctggctggtgccgggttggcattttcactgatcaaaaacgctcagacaccccgaagaggaaccggcactgccggtgagacactcggcgaaaagtggaaaaggcagctgaattctttagaccggaaggagttcgaagagtacaagcgcagtgggattcttgaggtggacagaaccgaagcgaaatcggccctgaaggatggaagcaaaatcaagcatgcagtttccaggggctcttcaaaaatacgatggatcgtggagcgggggatggtcaagccaaagggaaaagtggtcgacctcggctgcggtcgtgggggatggagctactatatggctacgctaaagaacgtgaccgaagttaaaggctacacaaagggcgggcccggacacgaggaacctattccgatggccacttatggttggaatctggtaaaattgcattccggcgtggatgtcttttacaagcccaccgagcaagtggacacactgctctgtgatatcggggagagttctagcaacccaactattgaagagggaagaaccatgcgcgttcttaagatggtggaaccttggctgtcatccaaacccgagttctgcatcaaggtcttgaatccttatatgccaacagtgattgaagagctggagaaactccagaggaagcacggcggtaacttagtacggtgtcccctgagtagaaatagcacccacgaaatgtactgggtgtctggggcatccggaaacatcgtttcaagcgtcaatactacgtcgaaaatgcttctgaaccgctttacaaccaggcatcgaaagcctacttatgagaaagacgtggatctaggcgctggcacccggtctgtgagtacagaaacggagaagccagacatgaccataattgggagaaggctccagcgcctgcaggaggaacacaaggagacttggcattacgatcaagaaaatccctaccgtacatgggcctatcacggatcctacgaggccccgagcaccggttcagcgtcctctatggtcaacggcgttgtgaaattgctgactaagccttgggacgtaatcccaatggtgacacagctcgctatgaccgatacaactcccttcgggcagcagcgggtctttaaagaaaaggtggacaccagaacgcctcaaccaaaacccggaaccaggatggttatgacaactaccgcaaattggctttgggccctgttaggcaagaagaaaaacccgcgcctgtgcacacgagaggagttcatcagcaaggtgcggagtaatgctgccattggtgcagtctttcaggaagagcaggggtggacttccgccagcgaagctgtgaacgactctagattctgggagttggtagataaagaaagggcgctccaccaagagggaaagtgtgagtcatgcgtttataacatgatgggcaaacgcgaaaagaagctgggcgagtttgggagagccaaaggaagtcgggcaatatggtacatgtggctaggtgctaggttccttgaattcgaggccctgggctttctcaatgaagaccattggttcgggcgtgagaactcctggagcggagtggagggcgaaggtctgcaccgattggggtatatcctggaggaaattgataagaaagacggagatctcatgtacgcagacgataccgccggctgggacacgcgcatcacagaggatgaccttcagaatgaggaactgattaccgagcagatggctcctcatcacaagatcttagccaaagcgatatttaagctgacttatcagaacaaggtcgtgaaagtgttgagacccacaccacggggcgcagtcatggatatcatttctaggaaggaccaacgcgggtcgggacaggttggtacctacggcctcaatactttcaccaacatggaagtgcagctgatcagacagatggaggccgaaggggtaattacacaagatgacatgcagaatcctaaaggactaaaggagcgggtggagaaatggcttagggaatgcggcgtcgaccgactgaagcgtatggctatctcaggtgatgactgtgtggttaaacccctcgatgagagatttgggacgagcctgttgttcttaaacgacatgggaaaggtgcgcaaggatataccacagtgggaaccctccaaaggctggaagaattggcaggaggtccctttttgcagtcatcacttccacaaaatttttatgaaggacggccggtctctggtggtaccatgtaggaaccaagatgaactcatcgggagagcccgcatcagccagggagcaggttggtcccttcgggagaccgcttgcctgggcaaagcctacgctcagatgtggtcactaatgtatttccataggcgagacctgagactcgccagtatggcaatttgttctgcggttccgactgagtggtttcccacaagccggaccacttggtccatacacgcccatcaccagtggatgacaaccgaagatatgttgaaggtgtggaatagggtctggatcgaggacaaccctaatatgattgataagacgccagtgcactcatgggaagacatcccctacctggggaaacgcgaggacctttggtgcggaagcctgattggcctctcttcccgtgctacatgggccaagaacatccataccgcaataactcaagttagaaatttaatcggtaaagaagagtatgtggattacatgcctgtcatgaagcgatatagtgctccaagcgagtcggaaggggtgctgtga

SEQ ID NO: 15787 - RNA, 9867 nt, synthetic construct
  misc_feature 1..9867: note = derived and/or modified CDS sequence (opt3) from DENV-4__KJ596672__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatgctgggcgataccatgtccggcagaatcgggggacagacacatctagctataatcgccgttttcaagatgtctccgggttacgtgctgggcgtctttctcaggaaactgaccagccgtgagactgcacttatggtgattgggatggctatgacaaccacattgtcaatccctcacgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccaattacaatgaccctctggtatatgtggcaggtcaagactcaacgctccggggcactgtgggatgtgccgtcacctgccgcgacacagaaagctgccttgagtgagggagtttacagaatcatgcagaggggcttattcggcaagacccaggtgggggtcggaattcacatggaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggataaggaggaggacgtgcaagtactggccattgaaccaggaaagaaccccaaacatgtgcagacaaagcctggcctttttaaaaccctgacaggcgagatcggggctgttactttggacttcaagccaggaacctcaggtagtcccatcattaataggaaaggcaaggtcatagggctatacggaaacggcgtggtgacgaaaagcggtgattatgtctccgccatcacacaggcagaacgtattggggagcctgactacgaggtagatgaagacatctttcggaagaagagactgactattatggatctccacccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttatcagactccagccgtcaagtcggagcataccgggagagagatcgtggacctcatgtgccacgctacattcacgactcggctgcttagctcaaccagggttcccaattacaacctgattgtgatggatgaagcacactttacagacccttccagtatcgccgcccgcggatacatatctacccgagtcgagatgggtgaagctgcggcaattttcatgactgccacaccgcccggcgctaccgatccatttcctcaaagcaattcccccatcgaggacatcgaaagagagattccagagcggtcatggaacacggggttcgattggatcactgactatcagggaaaaacagtgtggtttgtaccttctataaaggccggcaatgacattgcaaactgcttgaggaagagcggtaaaaaggtgatccagctaagtcgcaaaaccttcgataccgaataccccaagactaaactgacagactgggattttgttgtcaccacagacatttccgagatgggggccaacttcagagctggcagggtgatcgatccacggcgttgtctcaagccggtgatattaactgacggacctgaacgcgtcattctggcgggccccatcccagttacgcccgccagcgcagctcaacgaagagggaggatcggacggaatcctgcccaggaggatgaccagtatgtgttctctggtgatccacttaagaacgacgaagatcatgcacactggaccgaggccaaaatgctgctcgacaatatttacacacccgagggcatcattcctactttgtttgggccggaacgcgagaagacccaggctatagatggagaattcagactgaggggcgagcaacggaaaacatttgtagagctcatgcgaagaggtgacctgccagtgtggctttcatataaggtcgcctccgcggggatcagttacaaagaccgcgaatggtgcttcaccggcgagaggaacaatcagattctagaagagaacatggaagtggagatctggactcgggagggagaaaagaagaaactgcgtcccaagtggttggatgcaagagtttatgccgaccctatggctttaaaagattttaaggagttcgccagcggcaggaaatcgatcacgctggacattctcaccgaaatagcttctctgcccacatacctttccagccgcgcaaagctggccctcgataatatcgtgatgttgcatactaccgagcgggggggacgagcttaccagcacgccctgaacgaactaccagagtcactggagacactcatgcttgtcgcactgttaggtgcgatgaccgccggcatttttttgttctttatgcaggggaagggaatcggcaaactgagtatgggtctcattactatcgctgtagcctctgggctgctttgggtggcagaaatacaacctcagtggatcgctgcctccattatcctggagttctttctcatggttttgctgattcccgaaccagagaagcagagaacacctcaggacaatcaattaatctatgtgatactaacgattctgaccatcattggcctcatcgcagccaacgaaatgggacttatagagaaaactaagacagatttcggcttttaccaggtcaaaaccgagaccacaatcctggacgtggatttgaggccggctagcgcgtggactctgtatgccgtcgcaacgaccattctcacacccatgctgcgccacactatcgaaaatacctcagctaaccttagtctcgccgccattgcaaatcaggctgccgtgctgatggggttgggaaagggctggccactgcatcggatggacttaggtgttcctctactggcgatggggtgttacagccaggtgaaccccacaaccctcactgcttcccttgtaatgctgttggtgcactatgccatcataggaccaggcctgcaagcaaaagccacgagagaggctcagaagcgtacagcagccggtattatgaagaatcctaccgtcgatggcatcactgttatcgacctcgaacccatttcttacgatccgaaattcgagaagcagctggggcaagtgatgcttttagtcctgtgcgcgggacagctcttgctgatgaggaccacatgggctttctgtgaggtgctaactctggccaccggcccaatcctcacactttgggaagggaaccctggacggttttggaacacgaccatagcagtaagcactgccaatattttccgcggctcctatctggctggtgccgggttggcattttcactgatcaaaaacgctcagacaccccgaagaggaaccggcactgccggtgagacactcggcgaaaagtggaaaaggcagctgaattctttagaccggaaggagttcgaagagtacaagcgcagtgggattcttgaggtggacagaaccgaagcgaaatcggccctgaaggatggaagcaaaatcaagcatgcagtttccaggggctcttcaaaaatacgatggatcgtggagcgggggatggtcaagccaaagggaaaagtggtcgacctcggctgcggtcgtgggggatggagctactatatggctacgctaaagaacgtgaccgaagttaaaggctacacaaagggcgggcccggacacgaggaacctattccgatggccacttatggttggaatctggtaaaattgcattccggcgtggatgtcttttacaagcccaccgagcaagtggacacactgctctgtgatatcggggagagttctagcaacccaactattgaagagggaagaacccttcgcgttctgaagatggtggaaccttggttgtcatccaaacccgagttctgcatcaaggtcctgaatccttatatgccaacagtgattgaagagctcgagaaattacagaggaagcacggcggtaacctggtacggtgtccccttagtagaaatagcacccacgaaatgtactgggtgtctggggcatccggaaacatcgtttcaagcgtcaatactacgtcgaaaatgctgctaaaccgctttacaaccaggcatcgaaagcctacttatgagaaagacgtggatctcggcgctggcacccggtctgtgagtacagaaatagagaagccagacatgacgattatcgggagaaggctgcagcgcttgcaggaggaacacaaggagacctggcattacgatcaagaaaatccctaccgtacttgggcctatcacggatcctacgaggccccgagcacaggttcagcgtcctctatggtcaacggcgttgtgaaactgctcaccaagccttgggacgtaatcccaatggtgactcagcttgctatgacagataccacacccttcgggcagcagcgggtctttaaagaaaaggtggacactagaacccctcaaccaaaacccggaacgaggatggttatgaccacaactgcaaattggctgtgggccttactgggcaagaagaaaaacccgcgcttgtgcacccgagaggagttcattagcaaggtgcggagtaatgctgccataggtgcagtctttcaggaagagcaggggtggacatccgccagcgaagctgtgaacgactctagattctgggagctcgtagataaagaaagggcgctgcaccaagagggaaagtgtgagtcatgcgtttataacatgatgggcaaacgcgaaaagaagctaggcgagtttgggagagccaaaggaagtcgggcaatctggtacatgtggcttggtgctaggttcctggaattcgaggccctcggctttctgaatgaagaccattggttcgggcgtgagaactcctggagcggagtggagggcgaaggtttgcaccgactggggtatattctcgaggaaatcgataagaaagacggagatcttatgtacgcagacgatactgccggctgggacacccgcattacggaggatgacctgcagaatgaggaattaatcacagagcagatggctcctcatcacaagatactggccaaagcgatctttaagttgacctatcagaacaaggtcgtgaaagtgctcagacccactccacggggcgcagtcatggatattatctctaggaaggaccaacgcgggtcgggacaggttggtacatacggcctgaataccttcactaacatggaagtgcagctaattagacagatggaggccgaaggggtaatcacccaagatgacatgcagaatcctaaaggacttaaggagcgggtggagaaatggctgagggaatgcggcgtcgaccgactcaagcgtatggctatatcaggtgatgactgtgtggttaaacccctggatgagagatttgggacaagcttgttattcctgaacgacatgggaaaggtgcgcaaggatattccacagtgggaaccctccaaaggctggaagaattggcaggaggtccctttttgcagtcatcacttccacaaaatctttatgaaggacggccggtctctcgtggtaccatgtaggaaccaagatgaacttatcgggagagcccgcattagccagggagcaggttggtccctgcgggagacggcttgcctaggcaaagcctacgctcagatgtggtcactgatgtatttccataggcgagacctcagattggccagtatggcaatatgttctgcggttccgaccgagtggtttcccactagccggacaacctggtccatccacgcccatcaccagtggatgactacagaagatatgctgaaggtgtggaatagggtctggattgaggacaaccctaatatgatcgataagaccccagtgcactcatgggaagacattccctaccttgggaaacgcgaggacctgtggtgcggaagcctcatcggcttatcttcccgtgctacgtgggccaagaacatacatacagcaatcacccaagttagaaatctgattggtaaagaagagtatgtggattacatgagtgtcatgaagcgatatagcgctccttcggagtccgaaggggtgttgtga

SEQ ID NO: 15788 - RNA, 9867 nt, synthetic construct
  misc_feature 1..9867: note = derived and/or modified CDS sequence (opt3) from DENV-4__KJ579242__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatcctgggcgataccatgtccggcagaatagggggacagacacatctagctatcatggccgttttcaagatgtctccgggttacgtgctgggcgtctttctcaggaaactgaccagccgtgagactgcacttatggtgattgggatggctatgacaaccacattgtcaatccctcacgacctgatggagttaattgacggaatcagtctcggcctgatacttctgaagattgtaactcagttcgataacacccaagtgggtacgctagccctctccctgacatttatccgctctaccatgagcttggtcatggcatggcggactatcatggccgttctgttcgtggtgaccttaattccactctgtagaacatcctgcctgcagaaacagtcacattgggtcgaaatcactgctcttattctgggggcgcaagccttgcccgtgtatctcatgaccctgatgaagggagcaagcaggcgaagttggcctctaaatgagggcataatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatatcacgggaagttcccctattatcgaagtgaagcaggacgaggatggcagcttttctattcgggacgtcgaggaaacaaacatgatcaccttgctcgtgaaactggccctaataactgtaagcggtctgtacccccttgctatcccaattacaatgaccctctggtatatgtggcaggtcaagactcaacgctccggggcactgtgggatgtgccgtcacctgccgcgacacagaaagctgccttgagtgagggagtttacagaatcatgcagaggggcttattcggcaagacccaggtgggggtcggaattcacatggaaggtgtgttccacacgatgtggcatgttactcggggcagcgtgatctgtcacgagaccgggcgactggaaccctcttgggcagacgtcagaaatgatatgatatcctatggaggcggttggcgcctcggggacaaatgggataaggaggaggacgtgcaagtactggccattgaaccaggaaagaaccccaaacatgtgcagacaaagcctggcctttttaaaaccctgacaggcgagatcggggctgttactttggacttcaagccaggaacctcaggtagtcccatcattaataggaaaggcaaggtcatagggctatacggaaacggcgtggtgacgaaaagcggtgattatgtctccgccatcacacaggcagaacgtattggggagcctgactacgaggtagatgaagacatctttcggaagaagagactgactattatggatctccacccgggagctggcaaaaccaagaggatcctgccatctatagtgcgcgaggcccttaaacgaagattacggacactgatcctcgcgcccaccagggttgtggccgcagaaatggaggaagctttgcgcggcctgcctattcgttatcagactccagccgtcaagtcggagcataccgggagagagatcgtggacctcatgtgccacgctacattcacgactcggctgcttagctcaaccagggttcccaattacaacctgattgtgatggatgaagcacactttacagacccttccagtgtcgccgcccgcggatacatctctacccgagtggagatgggtgaagctgcggcaatattcatgactgccacaccgcccggcgctaccgatccatttcctcaaagcaattcccccattgaggacatcgaaagagagatcccagagcggtcatggaacacggggttcgattggattactgactatcagggaaaaacagtatggtttgtgccttctatcaaggccggcaatgacatagcaaactgcttgaggaagagcggtaaaaaggttattcagctaagtcgcaaaaccttcgataccgaataccccaagactaaactgacagactgggattttgtcgtgaccacagacatctccgagatgggggccaacttcagagctggcagggtgattgatccacggcgttgtctcaagccggtcatcttaactgacggacctgaacgcgttatactggcgggccccattccagtgacgcccgccagcgcagctcaacgaagagggaggatcggacggaatcctgcccaggaggatgaccagtatgtattctctggtgatccacttaagaacgacgaagatcatgcacactggaccgaggccaaaatgctgctcgacaatatctacacacccgagggcattatccctactttgtttgggccggaacgcgagaagacccaggctattgatggagaattcagactgaggggcgagcaacggaaaacatttgtggagctcatgcgaagaggtgacctgccagtctggctttcatataaggtggcctccgcggggataagttacaaagaccgcgaatggtgcttcaccggcgagaggaacaatcagatcctagaagagaacatggaagttgagatttggactcgggagggagaaaagaagaaactgcgtcccaagtggttggatgcaagagtgtatgccgaccctatggctttaaaagattttaaggagttcgccagcggcaggaaatcgatcacgctggacatcctcaccgaaattgcttctctgcccacatacctttccagccgcgcaaagctggccctcgataatatagtcatgttgcatactaccgagcgggggggacgagcttaccagcacgccctgaacgaactaccagagtcactggagacactcatgcttgtagcactgttaggtgcgatgaccgccggcatctttttgttctttatgcaggggaagggaattggcaaactgagtatgggtctcatcactattgctgtggcctctgggctgctttgggttgcagaaatccaacctcagtggatagctgcctccatcattctggagttctttctcatggtgttgctgatccccgaaccagagaagcagagaacacctcaggacaatcaattaatttatgtcatcctaacgatactgaccattatcggcctcattgcagccaacgaaatgggacttatcgagaaaactaagacagatttcggcttttaccaggtgaaaaccgagaccacaatactggacgtcgatttgaggccggctagcgcgtggactctgtatgccgtggcaacgaccatcctcacacccatgctgcgccacactattgaaaatacctcagctaaccttagtctcgccgccatcgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccattatcggaccaggcctgcaagcaaaagccacgagagaggctcagaagcgtacagcagccggtataatgaagaatcctaccgttgatggcattactgtgatcgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaattctcacactttgggaagggaaccctggacggttttggaacacgaccatcgcagtgagcactgccaatatattccgcggctcctatctggctggtgccgggttggttttttcactgattaaaaacgcacagacaccccgaagaggaaccggcactgctggtgagacactcggcgaaaagtggaaaaggcagctgaattctttagaccggaaggagttcgaagagtacaagcgcagtgggatccttgaggtggacagaaccgaagccaaatcggcgctgaaggatggaagcaaaattaagcatgccgtctccaggggctcttcaaaaatccgatggatagtggagcgggggatggtcaagccaaagggaaaagtggttgacctcggctgcggtcgtgggggatggagctactatatggcaacgctaaagaacgtaaccgaagtgaaaggctacacaaagggcgggcccggacacgaggaacctatcccgatggctacttatggttggaatctggtcaaattgcattccggcgtggatgttttttacaagcccaccgagcaagtggacacactgctctgtgatattggggagagttctagcaacccaactatcgaagagggaagaaccatgcgcgtccttaagatggtggaaccttggctgtcatccaaacccgagttctgcattaaggtattgaatccttatatgccaacagtgatcgaagagctggagaaactccagaggaagcacggcggtaacttagttcggtgtcccctgagtagaaatagcacccacgaaatgtactgggtctctggggcctccggaaacattgtgtcaagcgtgaatactacgtcgaaaatgcttctgaaccgctttacaaccaggcatcgaaagcctacttatgagaaagacgtcgatctaggcgcaggcacccggtctgttagtacagaaacggagaagccagacatgaccatcatagggagaaggctccagcgcctgcaggaggaacacaaggagacttggcattacgatcaagaaaatccctaccgtacatgggcttatcacggatcctacgaggccccgagcaccggttcagcctcctctatggtgaacggcgtagtgaaattgctgactaagccttgggacgtcattccaatggtgacacagctcgcgatgaccgatacaactcccttcgggcagcagcgggtttttaaagaaaaggtggacaccagaacgcctcaaccaaaacccggaaccaggatggtcatgacaactaccgctaattggctttgggcactgttaggcaagaagaaaaacccgcgcctgtgcacacgagaggagttcatcagcaaggtgcggagtaatgccgctatcggtgccgtatttcaggaagagcaggggtggacttccgcaagcgaagccgttaacgactctagattctgggagttggtggataaagaaagggctctccaccaagagggaaagtgtgagtcatgcgtctataacatgatgggcaaacgcgaaaagaagctgggcgagtttgggagagcgaaaggaagtcgggccatttggtacatgtggctaggtgcaaggttccttgaattcgaggctctgggctttctcaatgaagaccattggttcgggcgtgagaactcctggagcggagtggagggcgaaggtctgcaccgattggggtatatactggaggaaatcgataagaaagacggagatctcatgtacgccgacgataccgcaggctgggacacgcgcattacagaggatgaccttcagaatgaggaactgatcaccgagcagatggcccctcatcacaagattttagctaaagccatctttaagctgacttatcagaacaaggtggtcaaagttttgagacccacaccacggggcgcggtgatggatataatctctaggaaggaccaacgcgggtcgggacaggtaggtacctacggcctcaatactttcaccaacatggaagtgcagctgattagacagatggaggcagaaggggtcatcacacaagatgacatgcagaatcctaaaggactaaaggagcgggtggagaaatggcttagggaatgcggcgttgaccgactgaagcgtatggccatttcaggtgatgactgtgtggtcaaacccctcgatgagagatttgggacgagcctgttgttcttaaacgacatgggaaaggtgcgcaaggatatcccacagtgggaaccctccaaaggctggaagaattggcaggaggtacctttttgcagtcatcacttccacaaaatatttatgaaggacggccggtctctggttgtgccatgtaggaaccaagatgaactcattgggagagctcgcatcagccagggagccggttggtcccttcgggagaccgcatgcctgggcaaagcttacgcccagatgtggtcactaatgtatttccataggcgagacctgagactcgctagtatggccatctgttctgcagtcccgactgagtggtttcccacaagccggaccacttggtccattcacgcgcatcaccagtggatgacaaccgaagatatgttgaaggtgtggaatagggtttggatagaggacaaccctaatatgatcgataagacgccagtgcactcatgggaagacattccctacctggggaaacgcgaggacctttggtgcggaagcctgatcggcctctcttcccgtgccacatgggctaagaacattcataccgccatcactcaagtcagaaatttaataggtaaagaagagtatgtggattacatgcctgtaatgaagcgatatagtgcaccaagcgagtcggaaggggtgctgtga

SEQ ID NO: 15789 - RNA, 9867 nt, synthetic construct
  misc_feature 1..9867: note = derived and/or modified CDS sequence (opt3) from DENV-4__GQ398256__SS-prME
  source 1..9867: mol_type = other RNA
agcaccatgacactgctctgccttatacccactgtgatggccttccacctgtccacgagagacggcgaacctttgatgattgtcgctaagcatgaaagggggcggccattactgtttaaaaccaccgaaggaataaacaagtgtactcttatcgcaatggatctcggtgaaatgtgcgaagacaccgttacatacaaatgtccgctgcttgtgaataccgaacccgaggatattgactgctggtgtaacctgacttctacatgggtgatgtatggaacctgcacgcagaatggggagcgccgacgtgaaaagagatcagtggccttgactcctcacagtggaatgggcctcgagaccagggcggaaacatggatgagctccgagggtgcttggaaacatgcccagcgggtcgagtcttggatcctgcgcaacccagggttcgcactgctcgccggatttatggcttacatgattggccagactggcatccagagaaccgtgttctttgttttaatgatgctggtggcaccctcgtatgggatgaggtgtgtcggagtgggtaatcgggatttcgtagaaggcgtttcagggggagcctgggtggaccttgtcttggagcacggcggttgcgtgacaaccatggctcaggggaagcctacgctggattttgaactaactaagacaaccgccaaagaggtggcgctcctgcgcacttactgtatagaagcaagcatcagtaacattacaaccgccacgcgatgcccaacccaaggagagccctatcttaaggaggaacaggaccagcagtacatctgtagaagggatgtcgttgaccggggctggggcaatgggtgcggactgttcggtaaaggcggggtggtaacatgcgctaagtttttgtgttccggaaaaattactggcaacctcgtgcaaatcgagaatctggaatataccgtcgccgtgacagttcataacggtgatactcacgcagtggggaatgacacctctagccacggcgtcacagctaccataactcctcgttccccatcagtggaggtaaagttaccggattacggagaactgacgctcgactgcgagccccgcagtggcattgacttcaacgagatgatccttatgaagatgaaaaagaaaacatggctggttcataagcagtggtttttggatctacctctgccatggaccgccggggcggacactagcgaagtgcactggaatcataaagagagaatggtcaccttcaaggtgccccacgccaaaaggcaggatgtcacagtgctcggatctcaggaaggtgcaatgcactccgctctggccggcgctaccgaggttgactcaggggatggaaaccatatgtttgccggccaccttaagtgtaaggtgcggatggaaaaactgcgaattaagggtatgagctacactatgtgcagtgggaaattctctatcgacaaggagatggcagagacacaacatggcacgaccgtagtcaaagtgaagtatgaaggagccggcgctccttgtaaggttccaatcgagattcgcgatgtgaataaagaaaaggtcgtggggagaataatctccagcactcccttcgcggagaacacaaactcggtaaccaatattgagttggaaccgccttttggagactcttacatcgtgataggtgttggcgagtccgcactcacactgcactggttcaggaaagggtcaagtattggaaagatgtttgaaagcacttatcggggcgccaaacgcatggctatcttaggtgagaccgcctgggatttcgggtccgtcggcggactgtttacgtctctaggcaaggcagtgcatcaggtgttcgggagcgtctacaccacaatgtttggaggcgtttcatggatggtgagaatcctcattggtttcctggtgctttggatcgggactaacagtaggaatacctccatggccatgacatgcattgctgtaggaggcataactttgtttctgggtttcaccgtccaggccgacatgggctgtgtggttagctggaacgggaaggaactcaaatgcggatctggcatctttgtggtcgataatgtgcacacgtggacagagcaatataagttccagcccgagtcaccagcacgtctggcgagtgctattcttaacgcccacaaagacggggtttgtggaatccggagcaccactcgactggaaaatgtgatgtggaagcagatcacaaacgagttgaattacgtactctgggaaggcggtcatgacctgaccgtcgtggcaggggatgtgaaaggagtcttaactaagggcaagagagccctgacccctcccgttaacgacctaaaatattcctggaagacatggggtaaagctaagatttttacgccagaggccagaaattctaccttcctcatagatggccccgacacttcggaatgccctaacgagcgccgggcatggaatttctttgaggtggaagattacgggttcggaatgtttacaaccaacatctggatgaaattcagagagggcagctccgaagtatgtgaccacaggctgatgtcagctgccattaaggatcagaaagcggtgcatgccgacatggggtactggatcgagagttctaagaatcaaacatggcagattgaaaaggctagccttatcgaggtcaaaacttgcttgtggccaaagacccacacgctgtggtccaacggagtgctcgagtcacagatgctgataccgcgcagctatgcaggccccttttctcagcacaactaccgacaaggttatgccacacagaccgttgggccttggcatttaggaaaactggaaatcgatttcggcgagtgcccaggtactaccgtggctattcgggaagactgtgatcaccgtggcccctcccttagaacaactaccgccagtgggaagttggtcacacagtggtgctgtaggagctgcacgatgcctccactccgctttctgggagaggacggctgttggtacgggatggagatccggcccctatctgaaaaagaggaaaatatggtgaagtcccaggttaccgcaggacaaggcacttcagagacattcagtatgggtctgctctgcctgaccctttttgtggaagagtgtttgagaaggcgagtcactcgcaagcatatgattctggtagtggttatcacattctgcgcgataattttagggggactcacctggatggatctgcttcgggccctgatcatgttgggcgacacgatgagcggcagaattgggggacagatccacctcgctataatggccgtgtttaaaatgtcgccgggttatgtcctgggcgtgttcctaaggaagctgacttcccgtgagaccgcactcatggtaatcgggatggctatgacaaccgtgttttctattcctcatgacctgatggaacttatcgatggaattagcttgggcctgatcttactcaaaatagtcactcacttcgacaacacacaggttggtaccctggccctttcactgacattcctacgcagtactattccactcgtgatggcatggcggaccatcatggccgtgtttttcgtcgtgacgctgatccccttgtgtagaacatcctgcctgcagaagcaatctcactgggttgagattaccgctttaatcctcggggcgcaggccctgcctgtataccttatgactctgatgaaaggagcaagcaggcgatcctggcccttgaatgaaggcattatggctgtgggcctcgtctcactgctagggagcgccctgcttaagaacgatgtgccactcgccggacctatggttgctggtggcctgttgctggcagcctatgtgatgagtgggtcttccgcggacttaagcctcgagaaggctgccaatgtccagtgggatgaaatggcagacataaccggatcgtcacccatcattgaggtgaaacaagatgaggacggctcttttagtatccgggatgtagaagagacaaacatgattactctgcttgtcaagctggccttgatcaccgtgtccggtctctacccactggctataccggttacgatggcactatggtacatctggcaagtgaaaacacagcgcagcggggccctgtgggacgtcccttctcccgcggctacccagaaggccactcttagcgaaggagtgtatagaattatgcaaaggggcctcttcggcaaaacacaggttggggtgggaatccatatggagggtgtctttcacaccatgtggcatgtgactcggggctccgtaatttgtcacgaaacagggcgactggagccatcatgggcagatgtgagaaatgacatgatcagttacggaggcggttggcgcttgggggataagtgggacaaggaggaagacgttcaggtcttagccatagagcccggcaagaaccctaagcatgtgcagaccaaaccaggcctgttcaagacgctcactggcgaaattggggctgtgaccctggattttaaacccggaacaagcggttctcctatcatcaataagaaaggcaaggtcattgggctttatggaaacggcgtagtgaccaagtccggtgactacgtttcagccataacacaagcagagaggatcggggagccggattatgaagtggacgaggatattttccgtaaaaagcggctgactatcatggacttgcacccaggagctggcaaaaccaagaggattctacccagtatcgtcagggaagccctgaaacgccgactcagaacgctgatacttgcgcctacacgggtggttgccgcagagatggaagaggctttaaggggcctgccaatccgctaccagactcccgccgtaaagagcgagcacaccgggcgtgaaattgtcgatctcatgtgccatgctacatttaccactagattgctgtcctctacccgggtgcctaattataacctcatcgtaatggacgaggcacacttcacagatccgtgctcggtggccgccaggggatacattagcacgcgcgttgaaatgggtgaggctgcggcaatctttatgactgccacacccccaggcgctacagaccctttcccccagtcaaattccccaatagaagatattgagcgagagatccctgaaagaagttggaacaccgggttcgactggatcactgactaccagggaaagacagtctggtttgtgccctctattaaagccggcaatgatatcgcaaactgtctgagaaagagcggtaaaagggtgatacaactttcccgcaagaccttcgacacggagtatccaaaaactaagctgacagattgggactttgtcgttaccaccgatatttcagaaatgggggccaacttcagagctggcagggtgatcgacccgcggcgttgcttgaagcctgtaattctaactgatggacccgagcgcgtgatcctggcgggcccaatacccgtcactcctgcctctgcagctcagcgaagagggaggattggacggaatccagcccaggaagacgatcaatacgtgtttagcggtgaccccctcaaaaacgatgaggaccatgcacactggaccgaggccaagatgttactggataatatctatacacctgaaggcatcattccgactcttttcgggccagagcgcgagaaaacgcaggctatcgacggagagtttagactgaggggcgagcagcggaagaccttcgttgaactcatgaaacgaggtgacttgcccgtgtggctgagttacaaggtcgcctccgcggggattagctataaggatagagagtggtgttttacaggcgaacgcaacaatcagatactcgaggaaaacatggaggtagagatctggactaaagaaggagagaagaaaaagctgaggcctaaatggcttgacgcacgggtgtacgccgatcccatggctctaaaggacttcaaggaatttgcctctggccgtaaatcaattaccctggatatcttgacagagatcgcttccttaccaacctatctgagtagcaaggcaaaactcgccctggacaatattgttatgcttcacactacggaaaaaggtgggcgggcttaccaacatgccctgaacgagctccctgagtcgttggaaaccctgatgctagtggcactgctcggggcgatgacagccggcatattcctatttttcatgcaggggaaaggaatcggcaagctgtctatgggtttaattgctatcgccgtcgcatccgggttgctgtgggtggctgagattcagccccagtggatcgccgcaagcataatcctcgagttctttctgatggtccttctgattccagagcctgaaaaacaaaggactccgcaggataatcagctcatctacgtgattttgaccatcctgacaataattggcttaatcgccgctaacgagatgggactaattgagaagaccaagactgacttcggcttttatcaggttaaaacagaaacgaccatcctggatgtggacctccgccccgcgtcagcctggactctttacgcagtagctacaaccatactgaccccaatgttgcggcacacaatcgagaatacaagtgccaacctgtctctcgccgcaattgctaatcaagccgcggtgctgatggggcttggaaagggctggcctctccatcgaatggatctgggtgtccccttgctggctatcgggtgctattcccaggttaacccaacgaccttaacagccagcctagtgatgctgctcgtccactacgcaattatcggacctggccttcaggccaaagctactagagaagcacagaagaggaccgccgcgggtataatgaaaaatcccacagtggacggcattaccgtaatcgatctggagccgatctcatatgacccaaagttcgagaagcaattgggacaggtgatgctgctcgttctgtgtgtgggacagcttttactgatgcgcactacgtgggctctctgcgaagtcttgacactggccaccggccctgcaatgactctatgggaggggaaccccggacggttttggaacaccacaattgccgtgagtactgctaatatcttcagaggcagctacctggccggtgcagggctcgctttttcccttatcaaaaacgcccaaaccccacgtaggggaacaggcacgaccggtgaaactctgggcgagaagtggaaacggcagttgaactctctggaccgcaaggagttcgaagagtataaacgaagcgggattctcgaagtcgatagaacagaggcgaagtccgccctgaaggacggatcaaaaatcaagcatgcagtgtctaggggcagttcgaaaattcggtggatcgttgaacgcgggatggtaaagcccaaaggaaaggtggtcgatttaggctgtggtagagggggatggagctactacatggctacccttaagaatgtgactgaggttaaaggctatacaaagggcgggcctggacacgaagaaccgatacccatggccacctacggttggaatctggtgaaactccactccggcgtcgacgtgttttataagccaacggagcaggtagataccctactgtgcgacatcggggaatcttcaagcaaccctacaattgaggaaggaaggactttgcgagtgctgaaaatggttgagccctggctctccagtaagcctgagttctgtatcaaagtccttaatccatacatgcccaccgtgattgaggagctggaaaagttgcagcggcgttatggcggttctctggtgagatgccctctcagccgcaactcaacacatgagatgtactgggtctccggggcaagtggaaatatcgttagctctgtgaacactatttccaagatgttactgaataggtttaccacacggcacagaaaaccaacctatgaaaaggatgtagaccttggcgctggcactcgctcagtgagcacggagacagagaaacccgatatgaccgtcatcgggaggcgactgcaacggctacaggaagaacataaggaaacttggcactacgaccaggagaacccgtacagaacctgggcctatcacggatcgtacgaagccccttctacaggtagtgcgtccagcatggtgaatggcatagttaaactcctgacgaagccatgggatgtgattcccatggtcacccagttggctatgactgacacaacccctttcgggcaacagagggtgtttaaggagaaagtagacactcgcacaccacagcccaagccgggaacccgtatgatcatgacaactaccgcaaactggctgtgggccctccttggcaaaaagaaatcacctcggctgtgtacgagagaggagttcatctccaaggttaggtctaatgctgccattggtgcagtgttccaggaggaacaagggtggaccagcgccagtgaggctgtcaacgattcccgcttttgggaattagtgaataaggagcgagcgctgcatcaggagggaaaatgcgaaagctgcgtgtataacatgatgggcaagcgggagaaaaagttgggcgagttcgggagagccaaaggatctagggcaatatggtacatgtggctcggtgctcgctttctggagttcgaagccctaggctttcttaacgaggaccactggttctcaagagagaatagttggtccggggtcgaaggagagggcctgcatcggctcggttatatcctggaagatattgacaagcaggatggggacttgatctacgcagatgacacagccggatgggatactaggattaccgaggacgatctgctcaacgaggaacttatcacagagcaaatggctccccaccataagactctggccaaagcgatatttaagttaacctatcagaataaagttgtgaaggtactgcgtccaacgcctaaaggcgcagtgatggacatcattagccgaaaggatcagcgcggctctgggcaggtcggaacatacggtttgaacaccttcactaatatggaagtgcaactcatcagacagatggaggccgaaggcgttattacacaggacgacatgcagaaccccaaagggctgaaggagcgggtggagaagtggctaaccgaatgtggagtcgataggcttaaacgcatggctatctcgggcgacgattgcgtggtaaagccactggacgagagattttcagccagcctcctgttcttgaatgatatgggtaaagttcggaaggacataccccaatgggaaccttccaaagggtggaagaactggcaggaggtgccattttgtagtcaccacttccataagatttttatgaaagatggaaggtctttagtcgtgccgtgccgaaatcaggacgaactgatcggccgtgcaagaatcagccagggcgctgggtggtccctccgcgagactgcctgtcttggaaaggcttacgcccaaatgtggtcactgatgtatttccaccggagggatctaagactggcaagtatggcgatttgctctgccgttcccaccgagtggttccctacaagccgcacgacctggtccatacatgctcaccaccagtggatgactacagaagacatgctcaaagtgtggaaccgggtctggatcgaggataatccaaacatgaccgacaagactcccgtgcattcatgggaagacattccttacttgggtaaaagggaggatctgtggtgtggcagccttatcgggctgtcttcccgagccacatgggcaaagaatattcacaccgctatcacgcaggtaagaaacctcataggaaaggaagagtatgtggactacatgccagtcatgaaacggtatagtgcccccagcgagtcggaaggcgttttatga

SEQ ID NO: 15790 - RNA, 9867 nt, synthetic construct
  misc_feature 1..9867: note = derived and/or modified CDS sequence (opt3) from DENV-4__KC333651__SS-prME
  source 1..9867: mol_type = other RNA
agcaccatgactctgctctgccttatacccactgtgatggccttccacctgtccacgagagacggagaacctttgatgattgtcgctaagcatgaaagagggcggccattactgtttaaaaccacggaagggataaacaagtgtactttaatcgcaatggatctcggtgaaatgtgcgaggacaccgttacatacaaatgtccgctgcttgtgaataccgaacccgaggatattgactgctggtgtaacctgacttctacatgggttatgtatggaacctgcacgcagaatggggagcgccgacgtgaaaagagatcagtggccttgactcctcacagtggaatgggcctcgagaccagagcggaaacatggatgagctccgagggtgcttggaaacatgcccaacgggtcgagtcttggatcctgcgcaacccagggttcgcactgctcgccggatttatggcttacatgattggccagactggcatccagagaatagtgttctttgttttaatgatgctggtggcaccctcgtatgggatgaggtgtgtcggagtgggtaatcgggatttcgtagaaggcgtttcagggggagcctgggtggaccttgtcttggagcacggcggttgcgtgaccacaatggctcaggggaagcctaccctggattttgaactaacgaagactacagccaaagaggtggcgctcctgcgcacctactgtatcgaagcaagcattagtaacatcactacagccacccgatgcccaacgcaaggagagccctatcttaaggaggaacaggaccagcagtacatttgtagaagggatgtcgttgaccggggctggggcaatgggtgcggactgttcggtaaaggcggggtggtaacctgcgctaagtttttgtgttccggaaaaatcacaggcaacctcgtgcaaatagagaatctggaatatactgtcgtggttaccgtgcataacggtgatacacacgccgtcgggaatgacacttctaaccacggcgtgaccgcaacaattacccctcgtagcccatccgtagaggttaagttaccggattacggagaactgactctcgactgcgagccccgctcaggcatcgacttcaatgagatgattcttatgaagatgaaaaagaaaacgtggctggtgcataagcagtggtttttggatctacctctgccatggacagctggggccgacaccagtgaagtccactggaaccataaagagagaatggtgactttcaaggtcccccacgcgaaaaggcaggatgtgaccgttctcggaagccaggaaggtgccatgcactctgcactggctggcgccacagaggtggactccggggatggaaatcatatgtttgctggccaccttaagtgtaaggtacggatggaaaaactgcgaatcaagggtatgtcatacaccatgtgcagcgggaaattcagtatcgacaaggagatggccgagactcaacatggcacaacggtcgtgaaagttaagtatgaaggagcaggcgccccttgtaaggtgccaattgagatacgcgatgtcaacaaagaaaaggtggtagggagaatcatttcttccacccccttcgctgagaacactaatagcgtgacaaacatcgagttggaaccgccttttggagactcgtacatagttattggtgtcggcgagtctgcgctcaccctgcactggttcaggaaagggtcctcaatcggaaagatgtttgaaagtacatatcggggcgcaaaacgcatggccatcttaggtgagactgcttgggatttcgggagcgtgggcggactgtttacctccctaggcaaggccgtgcatcaggtcttcgggtctgtttacacgaccatgtttggaggcgtgagctggatggtgaggattctcatcggtttcctggtactttggattgggacaaattcaaggaacacaagtatggcaatgacctgcatagccgtcggaggcatcacattgtttctgggtttcactgtgcaggctgacatgggctgtgttgtgtcctggaatgggaaggaactcaaatgcggaagcggcatttttgtcgtggataacgttcacacctggacggagcaatataagttccagcccgagtctccagcccgtctggcatcagcgatccttaatgctcacaaagacggggtgtgtggaatccggagtacaacccgactggaaaacgtaatgtggaagcagattactaatgagttgaactacgtcctctgggaaggcggtcatgacctgacagtggtggccggggatgtcaaaggagttttaaccaagggcaagagagcactgactcctcccgtgaatgacctaaaatatagctggaagacctggggtaaagccaagatatttacaccagaggctaggaactccacgttcctcatcgatggccccgacacctctgaatgccctaatgagcgccgggcctggaacttctttgaggtagaagattacgggttcggaatgtttactacaaatatttggatgaaattcagagagggctcgagcgaagtgtgtgaccacaggctgatgtccgcagctatcaaggatcagaaagccgtccatgcggacatggggtactggattgagtcaagtaagaaccaaacctggcagatcgaaaaggcctctcttatagaggtgaaaacatgcttgtggccaaagactcacaccctgtggagcaacggagttctcgagtcccagatgctgatcccgcgctcatatgctggcccctttagccagcacaattaccgacaaggttatgcaacgcagacagtggggccttggcatttaggaaaactggaaattgatttcggcgagtgcccaggtaccactgtcgccatccgggaagactgtgatcaccgtggcccctctcttagaaccacaactgcttccgggaagttggtgacccagtggtgctgtaggagttgcacaatgcctccactccgctttctgggagaggacggctgttggtacgggatggagattcggcccctaagcgaaaaagaggaaaacatggttaagtctcaggtgacggccggacaaggcacctccgagactttctcaatgggtctgctctgcctgacactttttgtcgaagagtgtttgagaaggcgagtaacccgcaagcatatgatcctggtggttgtgataactttctgcgcaattatcttagggggactcacatggatggatctgcttcgggcgctgattatgttgggcgacaccatgagtggcagaatcgggggacagatacacctcgccatcatggctgtctttaaaatgagcccgggttatgtgctgggcgtattcctaaggaagctgacgtcgcgtgagactgccctcatggtgattgggatggcaatgaccacagtcttttccatccctcatgacctgatggaacttattgatggaatctctttgggcctgatattactcaaaattgttacccacttcgacaatactcaggtgggtacactggctcttagcctgaccttcctacgctcaacaatcccactcgtgatggcctggcggactatcatggcagtctttttcgtggttaccctgattcccttgtgtagaacgagttgcctgcagaagcactcccattgggtagagatcacagccttaattctcggggctcaagcgctgcctgtgtaccttatgaccctgatgaaaggagcctctaggcgaagctggcccttgaacgaaggcataatggcagtcggcctcgtgtccctgctagggtcagctctgcttaagaatgatgttccactcgccggacctatggtggccggtggcctgttgctggctgcatatgtcatgagcgggagttctgccgacttactcctggagaaggcggctaacgtgcagtgggatgaaatggccgacatcactggatccagccccattatcgaggtaaaacaggatgaggacggctcgttttcaattcgggatgtcgaagagaccaatatgatgacacttctggtgaagttggcactcatcactgtttctggtctgtacccactagccataccggtgaccatggctctgtggtacatctggcaagtcaaaacgcagcgcagtggggcactttgggacgtgccttcccccgccgcgacacagaaggctaccctcagcgaaggagtttatagaattatgcagaggggcctgttcggcaaaactcaagtgggggtcggaatccacatggagggtgtgtttcatacaatgtggcacgtaacccggggctctgtgatttgtcatgaaactgggcgattggagccaagctgggccgatgttagaaacgacatgatctcctacggaggcggttggcgcttaggggataagtgggacaaggaggaagacgtccaggtgctggcaatagagcccggcaagaatcctaagcacgtgcagacaaaaccaggcctcttcaagaccctgacgggcgaaattggggccgtcactcttgattttaaacccggaacctcaggtagtcctatcatcaacaagaaaggcaaggtaattgggctgtatggaaatggcgtggttacaaagagcggtgactacgtgtctgctataacccaggccgagaggatcggggagccggattatgaagtcgacgaggatattttccgtaaaaagcggttgacaatcatggacctacacccaggagcaggcaaaactaagaggattctgccctccatcgtgagggaagctctcaaacgccgactgagaacccttatattagcccctacgcgggttgtggcggccgagatggaagaggcactgaggggcctcccaatccgctaccaaacacccgctgtcaagtcagagcatactgggcgtgaaattgtggatttgatgtgccacgccacctttacaaccagactgctcagtagcactcgggtacctaactataatctgatcgtgatggacgaggctcatttcaccgatccgtgctccgttgcagccaggggatacatttctacacgcgtcgaaatgggtgaggccgctgcgatctttatgacggcaactcccccaggcgccaccgaccctttcccccagtcgaacagcccaatagaagatattgagcgagagatccctgaaagatcatggaatacagggttcgactggatcaccgactaccagggaaagactgtgtggtttgtgccctccattaaagctggcaacgatatcgccaactgtcttcggaagagtggtaaaagggtcatacagctgtctcgcaagacattcgacaccgagtatccaaaaacgaagttgactgattgggactttgttgtgacaaccgatattagcgaaatgggggcaaatttcagagccggcagggtaatcgacccgcggcgttgcctaaagcctgtgattctgaccgatggacccgagcgcgtcatcctcgctggcccaatacccgtgactcctgcgtccgccgcacaacgaagagggaggattggacggaacccagctcaggaagacgatcagtacgtattttcaggtgaccccctaaagaatgatgaggaccacgcccactggacagaggcaaagatgctgcttgataacatctatacccctgaaggcatcattccgacactgttcgggccagagcgcgagaaaactcaagccatcgacggagagtttagactcaggggcgagcagcggaagacgttcgtggaattgatgaaacgaggtgacctgcccgtctggctctcttacaaggtagctagcgccgggattagttataaggatagagagtggtgttttaccggcgaacgcaataaccagatactggaggaaaatatggaggtggagatctggacaaaagaaggagagaagaagaaacttaggcctaaatggctagacgcgcgggtttacgcagatcccatggccctgaaagacttcaaggaatttgcttccggccgtaaaagcattactttggatatcttaaccgagatcgcctctctgccaacatatctctcatccaaggctaaactggcacttgacaacattgtgatgctgcataccactgaaaaagggggcagagcctaccagcacgctctcaatgagttgcctgagagtctggaaacgctaatgctggtcgccctccttggtgcaatgaccgcgggcatattcctgtttttcatgcaagggaaaggaatcggcaagttaagcatgggtttgattgccatcgctgtggcctcggggctgctctgggtcgcagagattcagccccagtggatcgctgcctctataatcctggagttctttcttatggtgctgctcattccagagcctgaaaaacagaggacaccgcaagataaccagttgatctacgttattctgactatcttaaccataattggcctaatcgcagccaatgagatgggactgattgagaagacaaagaccgacttcggcttttatcaggtgaaaactgaaacaacgatcctcgatgtagaccttcgccccgcttccgcgtggaccctgtacgccgtggcaactacaatattgaccccaatgctgcggcataccatcgagaacacaagcgctaatctctcactggccgccattgcaaaccaggctgccgtccttatggggctcggaaagggctggcctctgcaccgaatggatttgggtgttcccctgttagcgatcgggtgctatagtcaagtgaatccaactacgctaaccgcttctctggtcatgctccttgtgcattacgccattatcggacctggcctgcaggcaaaagccacaagagaagctcagaagaggactgcagccggtataatgaaaaaccccaccgtagacggcattacagtgatcgatttggagccgatctcctatgacccaaagttcgagaagcagctggggcaagttatgctcctggtgctttgtgcgggacagttactgctcatgcgcaccacttgggctttgtgcgaagtcctgacgctagccacaggccctgcaatgaccctgtgggaggggaaccccggacggttttggaatactaccattgccgtgagcacagctaacatcttcagaggctcatacctcgccggtgcagggcttgcttttagtctgatcaaaaatgcccagactccacgtaggggaaccggcacaacgggtgaaaccttgggcgagaagtggaaacggcaactgaacagcctcgaccgcaaggagttcgaggagtataaacgatccgggattctggaagtcgatagaactgaggcgaagtctgccttaaaggacggaagcaaaatcaagcacgcagtgtccaggggctcatctaaaattcggtggatcgttgaacgcgggatggtaaagcccaaaggaaaggtggtcgatcttggctgtggtagagggggatggagttactacatggctacactgaagaatgtgaccgaggttaaaggctatactaagggcgggcctggacacgaagaaccgatacccatggccacatacggttggaacctcgtgaaactacattcgggcgtcgacgtgttttataagccaaccgagcaggtagatacgctgttgtgcgacatcggggaaagctcctctaatcctaccattgaggaaggaaggacactgcgagtgctcaaaatggttgagccctggctttcaagcaagcctgagttctgtatcaaagtcctgaacccatacatgcccactgtgattgaggagttggaaaagctgcagcggcgttatggcggttccctcgtgagatgccctttaagtcgcaattctacccacgagatgtactgggtcagcggggcatcaggaaacatcgtttccagtgtgaatacaattagcaagatgctgcttaacaggtttactacccggcatagaaaaccaacatatgaaaaggatgtagacctgggcgctggcacccgctctgtgtccactgagacggagaaacccgatatgacagtcatcgggaggcgactacagcggctccaagaagaacacaaggaaacctggcactacgaccaggagaatccgtacagaacttgggcctatcatggatcatacgaagcccctagcaccggttcggcgtctagtatggtgaacggcgttgtgaaactgttgacaaagccatgggatgtcatacccatggtgacgcagctggctatgaccgacactacacctttcgggcagcaaagggtatttaaggagaaagttgacacccgcactccacagcccaagccgggaacacgtatgattatgaccacaactgcaaattggctctgggcccttctgggcaaaaagaaatcccctcggttatgtaccagagaggagttcatcagcaaggtgaggtcaaacgctgccatcggtgcagtcttccaggaggaacaggggtggacgtccgcctctgaggctgtgaatgatagccgcttttgggaactggtggacaaggagcgagcgttgcaccaagagggaaaatgcgaaagttgcgtctataacatgatgggcaagcgggagaaaaagctcggcgagttcgggagagccaaaggatccagggcaatttggtacatgtggctgggtgctcgctttctagagttcgaagcccttggctttctgaacgaggatcattggttcagcagagaaaattcttggtcaggggttgaaggagagggcctccaccggctgggttatatattggaagacatcgataagcaggagggggacctgatttacgcagatgacaccgccggatgggatacaaggatcactgaggacgatctccttaacgaagaactgattaccgaacagatggctccccatcacaagacattagccaaagcgatctttaagctgacttatcaaaataaagtggtaaaggtgttgcgtccaacccctaaaggcgcagtcatggacataatcagtcgaaaggatcagcgcggctccggacaggtgggaacgtacggtctcaacacattcaccaatatggaggttcagctgattagacaaatggaagccgagggcgtgatcactcaggacgacatgcagaaccccaaagggctaaaggagcgggtcgaaaagtggcttacagagtgtggagtggataggctgaaacgcatggctattagcggcgacgattgcgtagttaagccactcgacgaaagattttctacctcgctgttgttcttaaatgatatgggtaaagtgcggaaggacatcccccagtgggagccttcaaaagggtggaagaactggcaagaagtcccattttgtagccaccatttccacaagatatttatgaaagatggaaggtccctggtggttccgtgccgaaatcaggacgagctcattggccgtgccagaatcagtcagggcgcagggtggtctcttcgcgagactgcttgtctgggaaaggcctacgctcagatgtggagcctaatgtatttccatcggagggatctgagactcgcctccatggcaatctgctcagcggtgcccaccgaatggttccctacaagtcgcacgacctggtctattcacgcccaccatcaatggatgactacagaggacatgttgaaagtctggaaccgggtgtggatagaagataatccaaacatgaccgacaagactcccgtacacagctgggaggacatcccttacctgggtaaaagggaagatctttggtgtggctccctgattgggctctcaagccgagctacatgggccaagaatatccataccgcaattacacaggtgagaaacttaatcggaaaggaggactatgtcgattacatgccagttatgaaacggtattctgctccctccgagagtgaaggcgtgctgtga

SEQ ID NO: 15791 - RNA, 9867 nt, synthetic construct
  misc_feature 1..9867: note = derived and/or modified CDS sequence (opt3) from DENV-4__JN559740__SS-prME
  source 1..9867: mol_type = other RNA
agcaccatcactctgctctgccttattcccactgtgatggccttccacctgtccacgagagacggcgaacctttgatgatagtcgctaagcatgaaagggggcggccattactgtttaaaaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagcggagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagcggaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcgtgccgtcgggaacgacatttccaatcacggcgtgaccgcaatgatcacacctcgctcaccaagtgtagaggttaagctgccggattacggagaattaaccctggactgcgagcccagaagcggcattgacttcaacgagatgatcctcatgaagatgaaaaagaaaacttggcttgtgcacaagcagtggtttctggatttgcctctaccatggacggctggggccgacacatctgaagtccattggaattacaaagagaggatggtgaccttcaaggtcccccacgcgaaacggcaggatgtgactgttctgggatcccaggaaggtgccatgcattcagcactcgctggcgccaccgaggtggacagcggggatggaaaccacatgtttgctggccacctgaagtgtaaggtacgaatggaaaaacttcgcatcaagggtatgagttatacaatgtgctctgggaaattctccattgacaaggagatggccgagacccaacatggcactacagtcgtgaaagttaagtacgaaggagcaggcgccccttgtaaggtgccaatagagatcagagatgtcaataaagaaaaggtggtagggaggattatcagctcgacgcccctggctgagaacaccaactctgtgactaatatagagttggaaccgcctttcggagactcctatattgttatcggtgtcggcaactcagcgctcacactgcactggtttcggaaagggagtagcatcggaaagatgttcgagtccacctaccgcggcgcaaaaagaatggccattttaggtgaaacagcttgggattttgggtctgtgggcggactgttcactagcctaggcaaggccgtgcatcaggtctttgggtcagtttataccacgatgttcggaggcgtgagttggatgatcaggattctcataggttttctggtgctttggatcgggaccaattcccgtaacacaagcatggcaatgacttgcattgccgtaggaggcatcaccttgttcctgggttttacagtccaggctgacatgggctgtgtggtttcttggtcagggaaggagctcaaatgcggaagtggcatcttcgtggtcgataatgtgcacacttggaccgaacaatacaagtttcagcccgagagcccagcccggctggcatccgcgattcttaacgctcataaagacggggtttgtggaatacgatctacgacaagactggagaatgtgatgtggaagcagatcaccaacgaattgaattatgtactctgggagggcggtcacgacctgactgtcgtggccggggatgtgaaaggagtcttaacaaagggcaagagggcactgacccctcccgtttcggacctaaaatacagctggaagacttggggtaaagccaagattttcaccccagaagctcgcaactccacatttctcatcgatggccccgacacgtcagagtgccctaatgaacggagagcctggaacagtctggaggtggaggattacgggttcggaatgttcaccactaatatttggatgaaatttagggaaggctctagcgaggtatgtgaccaccgccttatgtccgcagctatcaaggatcagaaagccgtgcatgcggacatggggtattggatagaatcaagcaagaaccaaacatggcagatcgagaaggcctctttgattgaagtcaaaacctgcctgtggccaaagacacacactctctggtccaatggagtgctggagagtcagatgttaatcccgaaaagctacgctggccccttctctcagcataactatcgacaaggttacgcaacccagacggttgggccttggcacctgggaaaacttgagattgattttggcgaatgcccaggtacaaccgtgactatccaggaggactgtgatcaccggggcccctccttgcgtaccacaactgcctcagggaaactcgtcacccagtggtgctgtagaagttgcacaatgcctccactgaggttcctaggagaagacggctgttggtatgggatggagatacgccccctgagcgagaaggaagagaacatggtgaagtcgcaagttacggctggacagggcacctccgaaactttttctatgggtctcctgtgccttacattgttcgtggaggaatgtctgcggagaagggtcacccgaaaacatatgattttagtagtggttatcactctctgcgccattatcctagggggccttacatggatggatctgttgcgcgcactcataatgctgggcgacaccatgagcggccggatcgggggacagattcacctagcgatcatggccgtgtttaagatgtcaccgggttacgtcctgggcgtgttcctcagaaaactgacgagtagggagactgctcttatggtaattgggatggccatgaccacagtgttgtccatccctcatgacctgatggagttaatagatggaatttctctcggcctgatccttctgaagatcgtcacccagtttgacaatactcaagttggtacactagcactcagcctgaccttcattcgttccacaatgccattggtgatggcttggcgcactatcatggccgtgctgtttgtcgtgaccttaattcccctctgtcggacgtcatgcctgcagaaacagagccactgggttgaaataacagcacttatcctgggggcccaggctttgcctgtatatctcatgaccctgatgaagggagcgagtagaaggtcttggcccctaaacgagggcattatggccgtgggcctggtctcccttctcgggagcgcactgttgaagaatgatgtgccactggctggacctatggttgccggtggcttactcctggccgcttacgtgatgtcggggtcatctgcagaccttagtctggaaaaagccgcgaacgtccagtgggatgagatggctgacatcactggatccagccccattatcgaagtgaagcaggatgaggacggctctttcagcatacgagatgtagaggaaaccaatatgatcacattgctcgtcaaactggccctaattactgtgtccggtctgtacccacttgcaatcccggttaccatgacgctctggtatatgtggcaagtgaagacacaacggtcaggggccctgtgggacgtccctagtcccgctgcaacccagaaagccgcgttgagcgagggagtgtaccgcattatgcagagaggcttatttggcaagactcaggttggggtgggaatccatatggaaggtgtcttccacacaatgtggcacgtgaccaggggctctgtaatatgtcatgagactgggcggctggaaccatcctgggctgatgtgcgaaacgacatgatttcatatggaggcggttggagactcggggataagtgggacaaagaggaggacgttcaagtcctggccatcgaacccggaaagaatcctaaacacgtgcagacaaagccaggccttttcaaaaccctgacgggcgagatcggggcagtgactttggattttaagcccggaaccagtggtagccctattataaaccgcaaaggcaaggtcatcgggctatacggaaatggcgtagtgacaaagtccggtgactatgtttctgccattacccaggctgaaaggatcggggagccggattacgaggtggacgaagatattttccgtaaaaagcggctgacaatcatggacctccatccaggagccggcaaaactaagagaatactgccctcgatcgtcagggaggcacttaaacgccgattaagaaccctgattctcgctcctacgcgggtggttgccgcggaaatggaggaagccttgaggggcctgccaatccgctatcagacacccgcagtgaaaagcgagcacactgggcgtgagattgtcgatctcatgtgccatgctacctttacaaccagactgctttcatccactcgggtgcctaactacaatctgatcgtaatggacgaagcccacttcaccgatccgagttctgtggctgcaaggggatacataagcacacgcgttgagatgggtgaagccgccgctatttttatgacggcgactcccccaggcgcaaccgaccctttcccccaatccaactcaccaatcgaggatatcgaacgagagattcctgagagatcttggaatacagggtttgactggatcaccgactatcagggaaagactgtctggttcgtgcccagcataaaagccggcaacgatattgctaattgcttgcggaagagtggtaaaaaggtgatccagctatccaggaaaacatttgacaccgaatacccaaagacgaagctgactgattgggacttcgtcgttacaaccgatattagcgagatgggggccaactttcgcgcaggcagagtgatcgacccgaggcggtgtctcaaacctgtaatattaaccgatggacccgaacgtgtgattctggccggcccaatccccgtcactcctgcttctgcggcccaacgccgagggagaatcggaaggaacccagcacaggaggacgatcagtatgtgttctcaggtgacccccttaagaatgatgaagaccacgctcattggacagaggccaaaatgctgctcgataacatttacacccctgagggcatcattccgacattgttcgggccagaacgggagaagactcaggcaatagacggagaatttcgcctgagaggcgagcaaaggaaaacgttcgttgagctcatgcggcgaggtgacctgcccgtgtggctttcctataaggtcgccagtgctgggatcagctacaaggatagagaatggtgctttaccggcgagcgcaataaccagattctagaagagaatatggaagtagagatctggacaagggagggagagaagaagaaactgcggcctcgttggttggacgccagagtgtatgcggatcccatggcattaaaggacttcaaagagtttgcctcgggcaggaagtctatcactctggatattctcaccgaaatagcttccctgccaacataccttagctcacgcgccaagctggctctcgacaacatcgttatgttgcacaccactgagagagggggacgagcataccagcatgccctgaatgaactacctgagagtctggagacgctcatgcttgtggctctgttaggtgccatgaccgcaggcattttcttgtttttcatgcaggggaaaggaatcggcaagctgtctatgggtctcattacaatcgcggtcgcctccgggctgctttgggtggctgaaatacaaccccagtggatcgccgcaagcattatcctggagtttttcctcatggtcttgctgattccagaacctgagaaacagagaactccgcaggataaccaattaatctatgtgatactaaccattctgacaatcattggcctcatcgctgccaatgaaatgggacttatagagaagaccaaaactgactttggcttctaccaggttaagacagagacgaccatcctggatgtggacttgaaacccgcatcagcctggactctgtatgctgtagcgacaaccattctcaccccaatgctgaggcacacaatcgaaaacacaagtgccaatcttagcctcgcagctattgccaaccaggccgcagtgctgatggggttgggaaagggctggcctctgcaccgcatggatttaggtgtccccctactggctatggggtgttactcccaggttaatccaatcacgctcaccgcctctcttgtgatgctgttggtccattatgcgataattggacctggcctgcaagctaaggccacacgggaggcacagaaaagaactgccgctggtatcatgaagaaccccaccgtggacggcatcacagtaattgatctcgaaccgatcagctacgacccaaaatttgagaagcagctggggcaagtgatgcttttagttctgtgcgcaggacagctcttgctgatgcgtaccacttgggccttctgtgaggtgctaacgctggcgacaggccctatactcaccctttgggaagggaatcccggaaggttctggaacactaccattgctgtctccacagccaacatctttcggggctcatatctggctggtgcagggttggcattctctctgattaaaaatgtgcagactccacgccgaggaaccggcacaacgggtgagaccctcggcgaaaagtggaagagacagctgaacagtttagacaggaaagagtttgaagagtacaagcggtcggggatccttgaggtcgatcgcactgaagccaaaagcgcactgaaggacggatccaaaataaagcacgctgtgtctagaggctcaagcaagatcaggtggattgttgagcgagggatggtaaaacccaagggaaaagtggtcgatctcggctgcggtagagggggatggtcctactatatggccacactaaagaatgtgaccgaagttaaaggctacactaagggcgggcctggacatgaggaaccgatccccatggcgacatatggttggaacctggtgaagttgcacagtggcgtcgacgtgttctacaaaccaaccgagcaagtagatacgctgctctgtgacattggggagtctagctcaaatcctaccatcgaagagggacgtacacttagagtgctgaagatggttgaaccctggttgtccagtaaacctgagttttgcattaaggtcctgaacccatatatgcccactgtgatcgaagaactcgagaaattacagcgcaagcatggcggtaatctggtgaggtgtcctcttagccggaactctacccacgaaatgtactgggtctccggggcctcaggaaatatagttagctcggtgaacacaacttctaaaatgctgctaaatagattcaccacacgccacaggaagccaacctatgagaaggatgtagacctcggcgcaggcactcgaagtgtgtccacggaaacagagaaacccgatatgaccattatcgggcggagactgcagaggttgcaggaggaacataaggagacttggcactacgaccaagaaaacccgtaccgcacctgggcttatcatggaagctacgaggccccttcaacaggttccgcatctagcatggtcaatggcgtggttaaactgctcacgaagccatgggatgtgatccccatggtcacccagcttgctatgactgacacaaccccttttgggcagcagcgtgtgttcaaagaaaaggtagacactcggacaccacaacccaagccgggaaccagaatggttatgacaactaccgccaactggctgtgggccttactgggcaaaaagaaaaatcctaggttgtgcacgcgcgaggagtttattagtaaggtgcgatccaacgcggctataggtgcagtcttccaggaagaacaggggtggaccagcgcctctgaagctgtgaatgattcacggttttgggagctcgtggacaaagaaagagccctgcaccaagagggaaagtgtgagagttgcgtctataacatgatgggcaagagggagaaaaagctaggcgagttcgggcgcgcaaaaggatccagagccatctggtacatgtggcttggtgctcggtttctggagttcgaggcgctcggcttcctgaacgaagatcactggtttgggagggagaatagctggtctggagttgagggcgaaggtttgcatcgtctggggtatattctcgaggaaatcgacaagaaagatggagaccttatgtacgccgatgacacagcaggctgggatactcgaattaccgaggacgatctgcagaacgaggaattaatcacagagcagatggctccccaccataagatactggccaaggcaatcttcaaattgacttatcagaataaggtggtaaaagtgctccgcccaacccctagaggcgccgtcatggacattatctcgcggaaggatcaaagggggtcaggacaggtgggtacgtacggcctgaacacatttaccaatatggaagttcagctaattcgccagatggaggctgaaggggtgatcactcaagacgacatgcagaaccccaaaggacttaaggagagagtcgagaaatggctgaaggaatgcggcgtggatcggctcaagaggatggccataagcggtgacgattgtgtagttaaaccactggacgagcgattcgggacatccttgttatttctgaatgatatgggaaaggtgcgtaaagacattccccagtgggaacctagtaagggctggaaaaactggcaggaggtcccattctgctctcaccattttcacaagatcttcatgaaggatggcagaagcctcgtggttccgtgtcgcaatcaagacgaacttatcgggcgggcgaggatttcccagggagcaggttggtcactgagagagaccgcctgcctaggcaaggcttacgcccagatgtggagtctgatgtattttcaccgccgggatctcaggttggcatctatggctatatgtagcgccgtgcccactgagtggttccctacctcccgaacaacgtggtcaatccatgctcaccatcagtggatgaccactgaagacatgctgaaggtctggaacagagtgtggattgaggataatccaaacatgacagacaaaacccccgtacacagctgggaagacatcccttaccttgggaagcgggaggatctgtggtgcggatctctcattggcttatccagtagggccacttgggccaaaaatatccacacagcgataacccaagtgcgcaacctgatcggtaaggaagagtatgtcgactacatgccagttatgaagcgttatagcgccccctcggagtccgaaggggtgttgtga

SEQ ID NO: 15792 - RNA, 9867 nt, synthetic construct
  misc_feature 1..9867: note = derived and/or modified CDS sequence (opt3) from DENV-4__JN559741__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatgctgggcgataccatgtccggcagaatcgggggacagacacatctagctataatggccgttttcaagatgtctccgggttacgtgctgggcgtctttctcaggaaactgaccagccgtgagactgcacttatggtgatcgggatggctatgacaaccacattgtcaattcctcacgacctgatggagttaatcgacggaattagtctcggcctgatccttctgaagatagtaactcagttcgataacacccaagtgggtacgctagccctctccctgacatttattcgctctaccatgagcttggtcatggcatggcggactatcatggccgttctgttcgtggtgaccttaatcccactctgtagaacatcctgcctgcagaaacagtcacattgggtcgaaattactgctcttatcctgggggcgcaagccttgcccgtgtatctcatgaccctgatgaagggagcaagcaggcgaagttggcctctaaatgagggcattatggctgttggcctggtatctcttctcgggtccgccctgttgaaaaacgacgtgcccctggccggaccaatggtcgctggtggcttactcctggcagcctacgtgatgagcgggtcgtcagcggatctttctctggaaaaggctgccaatgttcagtgggacgagatggcagatataacgggaagttcccctatcattgaagtgaagcaggacgaggatggcagcttttctatccgggacgtcgaggaaacaaacatgattaccttgctcgtgaaactggccctaatcactgtaagcggtctgtacccccttgctataccaatcacaatgaccctctggtatatgtggcaggtcaagactcaacgctccggggcactgtgggatgtgccgtcacctgccgcgacacagaaagctgccttgagtgagggagtttacagaattatgcagaggggcttattcggcaagacccaggtgggggtcggaatccacatggaaggtgtgttccacacgatgtggcatgttactcggggcagcgtgatttgtcacgagaccgggcgactggaaccctcttgggcagacgtcagaaatgatatgatctcctatggaggcggttggcgcctcggggacaaatgggataaggaggaggacgtgcaagtactggccatagaaccaggaaagaaccccaaacatgtgcagacaaagcctggcctttttaaaaccctgacaggcgagattggggctgttactttggacttcaagccaggaacctcaggtagtcccatcatcaataggaaaggcaaggtcattgggctatacggaaacggcgtggtgacgaaaagcggtgattatgtctccgccataacacaggcagaacgtatcggggagcctgactacgaggtagatgaagacatttttcggaagaagagactgactatcatggatctccacccgggagctggcaaaaccaagaggattctgccatctatcgtgcgcgaggcccttaaacgaagattacggacactgatactcgcgcccaccagggttgtggccgcagaaatggaggaagctttgcgcggcctgcctatccgttatcagactccagccgtcaagtcggagcataccgggagagagattgtggacctcatgtgccacgctacattcacgactcggctgcttagctcaaccagggttcccaattacaacctgatcgtgatggatgaagcacactttacagacccttccagtgtcgccgcccgcggatacatttctacccgagtggagatgggtgaagctgcggcaatcttcatgactgccacaccgcccggcgctaccgatccatttcctcaaagcaattcccccatagaggacattgaaagagagatcccagagcggtcatggaacacggggttcgattggatcactgactatcagggaaaaacagtatggtttgtgccttctattaaggccggcaatgacatcgcaaactgcttgaggaagagcggtaaaaaggttatacagctaagtcgcaaaaccttcgataccgaataccccaagactaaactgacagactgggattttgtcgtgaccacagacatttccgagatgggggccaacttcagagctggcagggtgatcgatccacggcgttgtctcaagccggtcattttaactgacggacctgaacgcgttatcctggcgggccccataccagtgacgcccgccagcgcagctcaacgaagagggaggattggacggaatcctgcccaggaggatgaccagtatgtattctctggtgatccacttaagaacgacgaagatcatgcacactggaccgaggccaaaatgctgctcgacaatatctacacacccgagggcatcattcctactttgtttgggccggaacgcgagaagacccaggctatcgatggagaattcagactgaggggcgagcaacggaaaacatttgtggagctcatgcgaagaggtgacctgccagtctggctttcatataaggtggcctccgcggggattagttacaaagaccgcgaatggtgcttcaccggcgagaggaacaatcagatactagaagagaacatggaagttgagatctggactcgggagggagaaaagaagaaactgcgtcccaagtggttggatgcaagagtgtatgccgaccctatggctttaaaagattttaaggagttcgccagcggcaggaaatcgattacgctggacatcctcaccgaaatcgcttctctgcccacatacctttccagccgcgcaaagctggccctcgataatattgtcatgttgcatactaccgagcgggggggacgagcttaccagcacgccctgaacgaactaccagagtcactggagacactcatgcttgtagcactgttaggtgcgatgaccgccggcatatttttgttctttatgcaggggaagggaatcggcaaactgagtatgggtctcattactatcgctgtggcctctgggctgctttgggttgcagaaattcaacctcagtggatcgctgcctccataatcctggagttctttctcatggtgttgctgattcccgaaccagagaagcagagaacacctcaggacaatcaattaatctatgtcattctaacgatcctgaccataattggcctcatcgcagccaacgaaatgggacttattgagaaaactaagacagatttcggcttttaccaggtgaaaaccgagaccacaatcctggacgtcgatttgaggccggctagcgcgtggactctgtatgccgtggcaacgaccatactcacacccatgctgcgccacactatcgaaaatacctcagctaaccttagtctcgccgccattgcaaatcaggctgccgttctgatggggttgggaaagggctggccactgcatcggatggacttaggtgtgcctctactggcgatggggtgttacagccaggtaaaccccacaaccctcactgcttcccttgtgatgctgttggtccactatgccatcattggaccaggcctgcaagcaaaagccacgagagaggctcagaagcgtacagcagccggtatcatgaagaatcctaccgttgatggcataactgtgattgacctcgaacccatctcttacgatccgaaattcgagaagcagctggggcaagtcatgcttttagtgctgtgcgcgggacagctcttgctgatgaggaccacatgggctttctgtgaggtactaactctggccaccggcccaatcctcacactttgggaagggaaccctggacggttttggaacacgaccattgcagtgagcactgccaatatcttccgcggctcctatctggctggtgccgggttggcattttcactgataaaaaacgctcagacaccccgaagaggaaccggcactgccggtgagacactcggcgaaaagtggaaaaggcagctgaattctttagaccggaaggagttcgaagagtacaagcgcagtgggattcttgaggttgacagaaccgaagcgaaatcggccctgaaggatggaagcaaaatcaagcatgcagtgtccaggggctcttcaaaaattcgatggatcgtcgagcgggggatggtgaagccaaagggaaaagtcgtggacctcggctgcggtcgtgggggatggagctactatatggctacgctaaagaacgttaccgaagtaaaaggctacacaaagggcgggcccggacacgaggaacctataccgatggccacttatggttggaatctggtgaaattgcattccggcgtcgatgtgttttacaagcccaccgagcaagttgacacactgctctgtgatatcggggagagttctagcaacccaactattgaagagggaagaacccttcgcgtgctgaagatggtcgaaccttggttgtcatccaaacccgagttctgcatcaaggtgctgaatccttatatgccaacagtaattgaagagctcgagaaattacagaggaagcacggcggtaacctggtgcggtgtccccttagtagaaatagcacccacgaaatgtactgggtttctggggcatccggaaacatcgtctcaagcgtgaatactacgtcgaaaatgctgctaaaccgctttacaaccaggcatcgaaagcctacttatgagaaagacgtggatctcggcgctggcacccggtctgtcagtacagaaacggagaagccagacatgaccattatcgggagaaggctgcagcgcttgcaggaggaacacaaggagacttggcattacgatcaagaaaatccctaccgtacatgggcctatcacggatcctacgaggccccgagcaccggttcagcgtcctctatggttaacggcgtggtaaaactgctcactaagccttgggacgtgataccaatggtcacacagcttgctatgaccgatacaactcccttcgggcagcagcgggtgtttaaagaaaaggttgacaccagaacgcctcaaccaaaacccggaaccaggatggtgatgacaactaccgcaaattggctgtgggccttactgggcaagaagaaaaacccgcgcttgtgcacacgagaggagttcattagcaaggtccggagtaatgctgccatcggtgcagtgtttcaggaagagcaggggtggacttccgccagcgaagctgtaaacgactctagattctgggagctcgttgataaagaaagggcgctgcaccaagagggaaagtgtgagtcatgcgtgtataacatgatgggcaaacgcgaaaagaagctaggcgagtttgggagagccaaaggaagtcgggcaatctggtacatgtggcttggtgctaggttcctggaattcgaggccctcggctttctgaatgaagaccattggttcgggcgtgagaactcctggagcggagtcgagggcgaaggtttgcaccgactggggtatattctcgaggaaatagataagaaagacggagatcttatgtacgcagacgataccgccggctgggacacgcgcatcacagaggatgacctgcagaatgaggaattaattaccgagcagatggctcctcatcacaagatcctggccaaagcgatttttaagttgacttatcagaacaaggtggtgaaagtcctcagacccacaccacggggcgcagttatggatatcatatctaggaaggaccaacgcgggtcgggacaggtgggtacctacggcctgaatactttcaccaacatggaagtacagctaatcagacagatggaggccgaaggggtgattacacaagatgacatgcagaatcctaaaggacttaaggagcgggtcgagaaatggctgagggaatgcggcgtggaccgactcaagcgtatggctatctcaggtgatgactgtgttgtgaaacccctggatgagagatttgggacgagcttgttattcctgaacgacatgggaaaggtccgcaaggatattccacagtgggaaccctccaaaggctggaagaattggcaggaggtgcctttttgcagtcatcacttccacaaaatctttatgaaggacggccggtctctcgtagttccatgtaggaaccaagatgaacttatagggagagcccgcattagccagggagcaggttggtccctgcgggagaccgcttgcctaggcaaagcctacgctcagatgtggtcactgatgtatttccataggcgagacctcagattggccagtatggcaatctgttctgcggtgccgactgagtggtttcccacaagccggaccacttggtccatccacgcccatcaccagtggatgacaaccgaagatatgctgaaggtctggaatagggtgtggattgaggacaaccctaatatgatagataagacgccagttcactcatgggaagacatcccctaccttgggaaacgcgaggacctgtggtgcggaagcctcattggcttatcttcccgtgctacatgggccaagaacatccataccgcaattactcaagtgagaaatctgatcggtaaagaagagtatgtcgattacatgcctgtgatgaagcgatatagtgctccaagcgagtcggaaggggtattgtga

SEQ ID NO: 15793 - RNA, 9867 nt, synthetic construct
  misc_feature 1..9867: note = derived and/or modified CDS sequence (opt3) from DENV-4__JQ513334__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccatggaggtggcgctcctgcgcacttactgtatcgaagcaagtatttccaatatcacaaccgccacgcgatgcccaacccaaggagagccctatcttaaagaggaacaggaccagcagtacatttgtagaagggatgtcgttgaccggggctggggcaacgggtgcggactgttcggtaagggcggggtggtaacatgcgctaaattttcttgtagcgagaagatcactggaaatttggtgcaaatagaaaacctcgagtataccgtcgtggttacagtgcataatggcgatactcacgccgtcggtaacgacacctccaatcacggggtgacagcaaccattactcctcgttcaccaagtgtagaagttgagctgccggattacggcgagttaacgctggactgcgaaccccgcagcggaatcgacttcaacgagatgattctcatgaaaatgaagaagaaaacatggcttgtgcataagcagtggtttctggatttgcctctaccatgggctgccggcgcggacacctctgaagtccactggaattacaaagagagaatggtgactttcaaggtcccccatgccaaaaggcaggatgtgaccgttctggggtcccaggaaggagcaatgcactcagctctcgccggtgctacagaggtggacagcggcgatgggaaccacatgtttgccggacatctgaagtgtaaagtacggatggagaagcttcgaatcaagggcatgagttataccatgtgctctggtaaattctccatcgacaaggaaatggcagagactcaacacgggacaacggtcgtgaaagttaagtacgaaggcgccggagctccttgtaaagtgccaattgagatacgcgatgtcaataaggagaaggtggtaggcagagtgatcagctcgattcccctggcggaaaacaccaactctgttactaatatcgagttggaaccgcctttcggggactcctatatagtcattggagtgggtaactcagcactcacactgcattggtttaggaaaggcagtagcatcgggaagatgttcgagtccacctaccggggagccaaacgcgtggctatcttaggcgaaacagcctgggattttggttctgtcgggggcctgttcactagcctaggaaaggcagttcaccaggtgtttggctcagtgtataccacgatgttcgggggagtaagttggatggtcagaattctcatcggcctgcttgtgttgtggattggtaccaattccaggaacacaagcatggccatgacttgcatagctgttgggggaatcaccctgtttctcggcttcacagtgcaggccgacatgggttgtgtcgtgtcttggtcaggccgtgagctgaaatgcgggagtggaatttttgttgtggataatgtacatacttggaccgagcaatacaagttccagcccgaaagcccagcacggcttgcgtccgctatcctgaacgcccacaaggacggcgtctgtgggatccgatctacgacaagattggagaatgtgatgtggaaacagattaccaacgaactcaattatgtgctgtgggagggaggccacgacttaactgtcgttgcaggtgatgtgaagggggtactgacaaaaggaaagagggccctaacccctcccgtgtcggacctcaaatacagctggaagacttggggcaaggctaaaatatttaccccagaagcccgcaactccacattcctgatcgatggtcccgacacgtcagagtgccctaatgagcggagagcatggaacagtcttgaagtcgaggattacggctttgggatgttcaccactaatatttggatgaagttcagggaaggatctagcgaggtgtgtgaccatcgcttgatgtccgctgccatcaaagatcagaaggcggttcacgccgacatgggctattggattgaatcaagcaaaaaccaaacatggcagatcgagaaggcttctctgatagaggtgaaaacctgcctctggccaaagacacatactctgtggtccaatggggtcttagaaagtcagatgctgatcccgaagagctacgcaggacccttttctcagcacaactatcgacaaggctacgccacccagacggtgggtccttggcaccttgggaaattggagattgatttcggagaatgcccaggcacaaccgttactatccaggaggactgtgatcatcggggtccctccctccgtaccacaactgcttcaggcaagctggtgacccagtggtgctgtagaagttgcacaatgcctccactaaggtttctgggggaggacggatgttggtatggcatggaaattcgccccctcagcgagaaagaagagaacatggtcaagtcgcaagtagccgcagggcagggaacgtccgaaaccttctctatgggcctgctttgcttgactctgtttgtggaggagtgtttacggagaagggttacacgaaaacacatgatcctcgcggtggtcataaccctgtgcgccattatccttggtgggctgacttggatggatttgctccgcgctctgattatgctaggagacacaatgagcggccggatcggcgggcagacccatctggccataatggcagtgttcaagatgtcaccgggatacgtactcggtgtgtttctgagaaagcttacgagtagggaaactgctttgatggtcatcggcatggccatgaccacaaccctgtccattcctcacgacttaatggagctcatcgatgggatttctctgggacttatcctgctaaaaatagttactcagttcgacaatacacaagtgggcaccctcgcactgagcttgacatttattcgttccactatgtcactggtgatggcctggcgcaccatcatggctgtcttattcgtggttacgctcatcccactgtgtcggacaagctgccttcagaagcagagtcattgggtagaaattaccgcgctgatcttgggtgcccaagcactccccgtgtatctgatgactctaatgaaaggggcttctagaaggtcctggcctctgaacgagggaattatggccgtcggccttgtgagcctcctgggctcggccttgctgaagaatgatgttcccttagctgggccaatggtggcaggaggtctcctgcttgccgcgtacgtcatgtcaggctctagtgctgacctgtccttggaaaaagccgcaaacgtgcagtgggatgagatggccgacataaccgggagctctcctatcattgaggtaaagcaggatgaagacggaagcttttccatccgagatgtcgaggaaacaaatatgattactctcctggtgaagctagctctgatcaccgtttcaggcctttaccccctcgcaataccagtgacgatgacactgtggtatatgtggcaggtcaaaacccaacggagtggtgccttgtgggacgtgccgagccctgcggctactcagaaggccgcattatctgagggggtttaccgcatcatgcagagaggactgttcggcaaaacacaggtgggcgtcgggattcacatggaaggagtgtttcacaccatgtggcatgtaactaggggttccgtgatctgtcacgagacaggccggctcgagccctcatgggccgatgttcgaaacgacatgattagttatgggggaggctggagactgggtgataagtgggacaaagaagaggacgtccaagtgcttgctatcgaaccagggaagaatcccaagcatgtgcagaccaaacctggactgttcaagacgttgactggcgagataggcgccgtcaccctagatttcaaaccagggacaagcggatcccccattatcaaccgcaagggtaaagtaatcggcctgtacgggaatggagtggttaccaagtctggcgactatgtgtcggcaattacacaggctgagaggataggtgaacctgattacgaggtcgacgaagatatctttcgtaaaaagcggctcactattatggacctgcacccgggggccggaaagaccaaaagaatccttccaagcattgtgagggaggcgttaaagcgccgactgagaacgctcatcttggcccccacacgggttgtggcagctgaaatggaggaggccctgaggggcctccctatacgctatcagactccagctgtcaaatcagaacataccggccgtgagatcgtggatctgatgtgccacgcaacattcaccactagacttctgtccagtacccgggtacccaactacaatttgattgtgatggacgaagcccactttacagatccttctagcgttgccgctagggggtacatctccacgcgcgtcgagatgggagaagcggcagccattttcatgactgctaccccgcccggtgccacagacccatttcctcaatcaaactctcccatcgaggatatagagcgagaaattccagagagaagctggaataccggcttcgactggatcactgactatcaggggaagacagtgtggtttgtgcctagtatcaaagcaggaaacgatattgccaattgcctacggaagtccggcaagaaagtcatccagctgagcaggaagaccttcgacacggaataccccaaaactaagctcacagattgggactttgttgtgaccaccgatatatctgagatgggtgctaacttccgcgcggggagagtaattgacccaaggcggtgtttaaaaccggtgatcctgactgatggccctgaacgtgtcattcttgccggacccatcccagtgacacccgcatcagctgcccaacgccgaggcagaatagggaggaaccctgcacaggaggacgatcagtatgttttttccggagacccactgaagaatgatgaggaccatgcccactggaccgaagctaagatgctcttggataacatttacacacccgagggtatcatccctactctgttcggcccggaacgggagaaaacgcaggccattgacggggagttccgcctcagaggagaacaaaggaagacctttgtggagctgatgcggcgaggcgaccttccagtctggctaagttataaagtagcgagcgcaggtatctcgtacaaggatagagaatggtgcttcacaggggagcgcaataaccagattctggaagagaatatggaggtggaaatatggactagggagggcgaaaaaaagaagttgcggccccgttggttagacgccagagtttatgctgatcctatggccctgaaagactttaaggagttcgcttctggaaggaaatccatcaccctcgatattctgacagaaatcgcaagccttcccacctacctgtcaagtcgcgccaagctcgctttggacaacatcgtgatgctgcatactacggagcggggcgggcgagcctaccagcacgcactaaatgagctgccagaatctctcgagacccttatgctggtcgcgttattgggagccatgacagctggtatttttctgttctttatgcagggcaaagggataggaaagctctccatgggcctgatcactattgccgtggcaagcggtcttctgtgggtcgctgaaatccaacctcagtggattgccgcatcaatcatactcgagttctttttgatggtgctgttaatccccgaaccagagaagcagagaacccctcaggataaccaactaatttatgttatcctggccattctcacaatcatagggcttattgctgcgaatgagatgggcctgatcgaaaaaaccaagactgacttcggattttaccaggtgaaaacagagacgaccattttggatgtagacctgaggccggccagtgcatggactctctatgctgtggccacaaccatcctgacccccatgcttcgccacacaatagaaaacactagcgccaatctctccctggcagctatcgccaaccaggcggctgtcttgatgggcctggggaagggatggccattacatcggatggatctaggcgttcctctgctcgccatgggttgttactctcaggtgaatcccacgacccttacagcaagcctggtcatgttgctggtgcactatgccattatcgggccaggactccaagctaaagcaactagagaggcccagaagcgtaccgcggctggcattatgaaaaaccctacagtagacggtatcaccgtgatagatctggagcccatttcctacgacccgaagttcgaaaagcagcttggccaagttatgttactggtgctctgcgccgggcagttgctgctaatgaggactacgtgggcattttgtgaggtcctgacactcgccaccggaccaatccttactctgtgggaaggcaatcctgggcggttctggaacaccacaatcgctgtgtcaactgccaacattttccgcggatcttatttggcaggcgctggtctggcctttagtctcatcaaaaatgcgcagaccccccgaagagggacaggaacgaccggcgagactctgggtgaaaagtggaaaaggcagttaaactcgcttgaccggaaggagttcgaggaatacaaacgcagcggcatactggaggtcgatagaacagaagccaagtccgcactcaaggacgggtctaaaattaagcatgctgtgtcaaggggaagctccaaaatccgatggattgttgagcggggcatggtaaagccaaaagggaaggtggtcgatctaggatgcggccgtggtgggtggagttactatatggccaccctgaagaatgtgactgaagttaaaggatacacaaagggcggccccgggcacgaggagcctatcccgatggcaacctatggatggaacttggtgaaactgcattctggtgtcgacgtgttttacaagcccacggaacaagtagataccctcctttgtgacataggcgagagctcatccaatccaacaatcgaagaggggagaactctgcgcgtgttgaaaatggttgaaccttggctgagtagcaagcccgagttctgcattaaggtcctcaacccttatatgccaaccgtgatcgaggaattagagaaactgcagaggaagcacggaggcaatcttgtgcggtgtcccctgtctagaaactccacacacgaaatgtactgggtctcaggtgctagcgggaatattgtttcgtctgtgaacactaccagtaaaatgctactcaatcgctttacaaccaggcatcgaaagcctacttatgagaaagatgtagacctgggagccggcacgcggtccgtgagcacagagaccgaaaagccagatatgactatcattggcagaaggttgcagcgcctgcaggaggaacacaaagagacctggcattacgaccaagaaaacccctaccgtacatgggcctatcacgggtcatacgaggcgccgtccacgggatctgctagcagtatggtcaatggtgtggttaagctccttaccaagccttgggatgtgatcccaatggtcactcagctggcaatgacagacaccactcccttcggccagcagcgggtgtttaaagagaaggtagacacaagaacccctcaaccaaaacccgggacaaggatggttatgactaccacggccaactggttatgggctctgttgggaaagaaaaagaatccgcgcctctgcacccgagaagagttcatatccaaggtgcggagcaacgccgcaattggcgccgtctttcaggaagagcagggttggacatctgcttcagaagcggtgaatgatagtagattctgggagctggtggacaaagagagggccctacaccaagaagggaagtgtgagtcctgcgtctataacatgatgggaaaacgcgaaaagaaacttggcgagtttggcagagcaaaggggagccgggctatctggtacatgtggctgggagccaggttcctcgaatttgaggcactgggtttcttgaacgaggatcattggttcggccgtgaaaattcttggtcgggggttgagggagaaggcctgcaccgactcggttatatccttgaggagattgacaagaaagatggggacctgatgtacgccgatgacactgctggatgggatacccgcataacagaagacgatttacagaacgaggaactgatcactgagcagatggcccctcatcacaagattttggcgaaagcaatctttaagctcacctatcagaataaagtggtaaaggtgctgagacccacgccacggggcgccgtcatggacattatctcaaggaaggatcaacgcggcagcgggcaggtgggaacatacggtctaaacaccttcactaatatggaagttcagcttataagacagatggaggctgagggcgtgatcacacaagacgacatgcagaaccctaaagggctgaaggaacgggtcgagaaatggctcagggaatgcggagtggatcgactgaagcgtatggccatttccggcgacgattgtgtagttaaacccttggacgagagatttggtaccagtttactgttcctcaatgatatggggaaggtgcgcaaagacatcccacagtgggaaccctctaagggatggaagaactggcaggaggtccctttttgcagccatcacttccacaaaatttttatgaaggatggccggtcccttgtggttccatgtaggaatcaagacgagctgatcggcagagcacgcatatcacagggggctggatggagtctacgggaaactgcctgcctgggtaaagcttacgcccagatgtggtctctcatgtatttccataggcgagatttgagactggcaagcatggcgatttgttccgccgtgccgaccgagtggtttcccacatcacggacgacctggagcatccacgctcatcaccagtggatgactacagaagacatgcttaaggtctggaacagggtgtggatcgaggataatcctaacatgattgacaaaaccccagtacactcttgggaagacataccctacctgggcaagcgcgaggatctctggtgcgggtccttaatcggactgagtagccgtgccacttgggcaaagaatattcatacagctatcacccaagtgagaaacttgattggcaaagaggaatatgtcgactacatgcctgttatgaagcgatattcggccccatccgagtctgaaggtgtgctgtga

SEQ ID NO: 15794 - RNA, 9867 nt, synthetic construct
  misc_feature 1..9867: note = derived and/or modified CDS sequence (opt3) from DENV-4__JQ513336__SS-prME
  source 1..9867: mol_type = other RNA
agcaccatcaccctgctctgccttattcccactgtgatggcattccacctgtccacgagagacggcgaacctttgatgatagtcgctaagcatgaaagagggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtgatgtatggaacctgcacgcagtcaggggagcgccgacgtgaaaagagaagtgtggcattgactcctcacagcggaatgggcctcgagaccagggcggaaacatggatgtcctctgagggtgcttggaaacatgcccagcgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtggaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcgagaaaatcactggaaatttggtgcaaatagaaaacctcgagtataccgtcgtggttacagtgcataatggcgatactcacgccgtcggtaacgacacctccaatcacggggtgacagcaaccattactcctcgttcaccaagtgtagaagttgagctgccggattacggcgagttaacgctggactgcgaaccccgcagcggaatcgacttcaacgagatgattctcatgaagatgaagaaaaagacatggcttgtgcataaacagtggtttctggatttgcctctaccatgggctgccggcgcggacacctctgaagtccactggaattacaaggagagaatggtgactttcaaagtcccccatgccaagaggcaggatgtgaccgttctggggtcccaggaaggagcaatgcactcagctctcgccggtgctacagaggtggacagcggcgatgggaaccacatgtttgccggacatctgaaatgtaaggtacggatggagaaacttcgaatcaaaggcatgagttataccatgtgctctggtaagttctccatcgacaaagaaatggcagagactcaacacgggacaacggtcgtgaaggttaaatacgaaggcgccggagctccttgtaaggtgccaattgagatacgcgatgtcaataaggagaaagtggtaggcagagtgatcagctcgattcccctggcggaaaacaccaactctgttactaatatcgagttggaaccgcctttcggggactcctatatagtcattggagtgggtaactcagcactcacactgcattggtttaggaagggcagtagcatcgggaaaatgttcgagtccacctaccggggagccaagcgcatggctatcttaggcgaaacagcctgggattttggttctgtagggggactgttcactagcctaggaaaagcagtccaccaggtttttggctcagtgtataccacgatgttcgggggagtgagttggatggtaaggattctcatcggcctgcttgtcttgtggattggtaccaattccaggaacacaagcatggccatgacttgcatagctgtagggggaatcaccctgtttctcggcttcacagttcaggccgacatgggttgtgtggtctcttggtcaggccgtgagctgaagtgcgggagtggaatttttgtggttgataatgtgcatacttggaccgagcaatacaagttccagcccgaaagcccagcacggcttgcgtccgctatcctgaacgcccacaaagacggcgtatgtgggatccgatctacgacaagattggagaatgtcatgtggaagcagattaccaacgaactcaattatgtgctgtgggagggaggccacgacttaactgtggtcgccggtgatgttaaaggggtgctgacaaagggaaaaagggccctaacccctcccgtatcggacctcaagtacagctggaagacttggggcaaagctaagatatttaccccagaagcccgcaactccacattcctgatcgatggtcccgacacgtcagagtgccctaatgagcggagagcatggaacagtcttgaagtggaggattacggctttgggatgttcaccactaatatttggatgaaattcagggaaggatctagcgaggtctgtgaccatcgcttgatgtccgctgccatcaaggatcagaaagcggtgcacgccgacatgggctattggattgaatcaagcaagaaccaaacatggcagatcgagaaggcttctctgatagaggttaagacctgcctctggccaaagacacatactctgtggtccaatggggtgttagaaagtcagatgctgatcccgaaaagctacgcaggacccttttctcagcacaactatcgacaaggctacgccacccagacggtcggtccttggcaccttgggaagttggagattgatttcggagaatgcccaggcacaaccgtgactatccaggaggactgtgatcatcggggtccctccctccgtaccacaactgcttcaggcaaactggttacccagtggtgctgtagaagttgcacaatgcctccactaaggtttctgggggaggacggatgttggtatggcatggaaattcgccccctcagcgagaaggaagagaacatggtgaaatcgcaagtcgccgcagggcagggaacgtccgaaaccttctctatgggcctgctttgcttgactctgtttgtagaggagtgtttacggagaagggtgacacgaaagcacatgatcctcgcggttgtgataaccctgtgcgccattatccttggtgggctgacttggatggatttgctccgcgctctgattatgctaggagacacaatgagcggccggatcggcgggcagacccatctggccataatggcagtcttcaagatgtcaccgggatacgtgctcggtgtatttctgagaaaacttacgagtagggaaactgctttgatggtgatcggcatggccatgaccacaaccctgtccattcctcacgacttaatggagctcatcgatgggatttctctgggacttatcctgctaaagatagtcactcagttcgacaatacacaagttggcaccctcgcactgagcttgacatttattcgttccactatgtcactggtgatggcctggcgcaccatcatggctgtgttattcgtcgtgacgctcatcccactgtgtcggacaagctgccttcagaaacagagtcattgggttgaaattaccgcgctgatcttgggtgcccaagcactccccgtatatctgatgactctaatgaagggggcttctagaaggtcctggcctctgaacgagggaattatggccgtgggccttgtcagcctcctgggctcggccttgctgaaaaatgatgtgcccttagctgggccaatggttgcaggaggtctcctgcttgccgcgtacgtgatgtcaggctctagtgctgacctgtccttggaaaaggccgcaaacgtccagtgggatgagatggccgacataaccgggagctctcctatcattgaggtgaagcaggatgaagacggcagcttttccatccgagatgtagaggaaacaaatatgattactctcctggtcaaactagctctgatcaccgtgtcaggcctttaccccctcgcaataccagttacgatgacactgtggtatatgtggcaagtgaagacccaacggagtggtgccttgtgggacgtcccgagccctgcggctactcagaaagccgcattatctgagggggtgtaccgcatcatgcagagaggactgttcggcaagacacaggttggcgtggggattcacatggaaggagtctttcacaccatgtggcatgtgactaggggttccgtaatctgtcacgagacaggccggctcgagccctcatgggccgatgtgcgaaacgacatgattagttatgggggaggctggagactgggtgataaatgggacaaggaagaggacgttcaagtccttgctatcgaaccagggaagaatcccaaacatgtgcagaccaagcctggactgttcaaaacgttgactggcgagataggcgccgtgaccctagatttcaagccagggacaagcggatcccccattatcaaccgcaaaggtaaggtcatcggcctgtacgggaatggagtagtgaccaaatctggcgactatgtttcggcaattacacaggctgagaggataggtgaacctgattacgaggtggacgaagatatctttcgtaagaagcggctcactattatggacctgcacccgggggccggaaaaaccaagagaatccttccaagcattgtcagggaggcgttaaaacgccgactgagaacgctcatcttggcccccacacgggtggttgcagctgaaatggaggaggccctgaggggcctccctatacgctatcagactccagctgtgaagtcagaacataccggccgtgagatcgtcgatctgatgtgccacgcaacattcaccactagacttctgtccagtacccgggtgcccaactacaatttgattgtaatggacgaagcccactttacagatccttctagcgtggccgctagggggtacatctccacgcgcgttgagatgggagaagcggcagccattttcatgactgctaccccgcccggtgccacagacccatttcctcaatcaaactctcccatcgaggatatagagcgagaaattccagagagaagctggaataccggcttcgactggatcactgactatcaggggaaaacagtctggtttgtgcctagtatcaaggcaggaaacgatattgccaattgcctacggaagtccggcaaaaaggtgatccagctgagcaggaaaaccttcgacacggaataccccaagactaaactcacagattgggactttgtcgttaccaccgatatatctgagatgggtgctaacttccgcgcggggagagtgattgacccaaggcggtgtttaaagccggtaatcctgactgatggccctgaacgtgtgattcttgccggacccatcccagtcacacccgcatcagctgcccaacgccgaggcagaatagggaggaaccctgcacaggaggacgatcagtatgtgttttccggagacccactgaagaatgatgaggaccatgcccactggaccgaagctaaaatgctcttggataacatttacacacccgagggtatcatccctactctgttcggcccggaacgggagaagacgcaggccattgacggggagttccgcctcagaggagaacaaaggaaaacctttgttgagctgatgcggcgaggcgaccttccagtgtggctaagttataaggtcgcgagcgcaggtatctcgtacaaagatagagaatggtgcttcacaggggagcgcaataaccagattctggaagagaatatggaggtagaaatatggactagggagggcgaaaagaagaaattgcggccccgttggttagacgccagagtgtatgctgatcctatggccctgaaggactttaaagagttcgcttctggaaggaagtccatcaccctcgatattctgacagaaatcgcaagccttcccacctacctgtcaagtcgcgccaaactcgctttggacaacatcgttatgctgcatactacggagcggggcgggcgagcctaccagcacgcactaaatgagctgccagaatctctcgagacccttatgctggtggcgttattgggagccatgacagctggtatttttctgttctttatgcagggcaaggggataggaaagctctccatgggcctgatcactattgccgtcgcaagcggtcttctgtgggtggctgaaatccaacctcagtggattgccgcatcaatcatactcgagttctttttgatggtcctgttaatccccgaaccagagaaacagagaacccctcaggataaccaactaatttatgtgatcctggccattctcacaatcatagggcttattgctgcgaatgagatgggcctgatcgaaaagaccaaaactgacttcggattttaccaggttaagacagagacgaccattttggatgtggacctgaggccggccagtgcatggactctctatgctgtagccacaaccatcctgacccccatgcttcgccacacaatagaaaacactagcgccaatctctccctggcagctatcgccaaccaggcggctgtgttgatgggcctggggaaaggatggccattacatcggatggatctaggcgtccctctgctcgccatgggttgttactctcaggttaatcccacgacccttacagcaagcctggtgatgttgctggtccactatgccattatcgggccaggactccaagctaaggcaactagagaggcccagaaacgtaccgcggctggcattatgaagaaccctacagtggacggtatcaccgtaatagatctggagcccatttcctacgacccgaagttcgaaaaacagcttggccaagtgatgttactggttctctgcgccgggcagttgctgctaatgaggactacgtgggcattttgtgaggtgctgacactcgccaccggaccaatccttactctgtgggaaggcaatcctgggcggttctggaacaccacaatcgctgtctcaactgccaacattttccgcggatcttatttggcaggcgctggtctggcctttagtctcatcaagaatgcgcagacaccccgaagagggacaggaacgaccggcgagactctgggtgaaaaatggaagaggcagttaaactcgcttgaccggaaagagttcgaggaatacaagcgcagcggcatactggaggtggatagaacagaagccaagtccgcactcaaagacgggtctaagattaaacatgctgtctcaaggggaagctccaagatccgatggattgtggagcggggcatggttaaaccaaaggggaaggtagtggatctaggatgcggccgtggtgggtggagttactatatggccaccctgaaaaatgtcactgaagtgaagggatacacaaaaggcggccccgggcacgaggagcctatcccgatggcaacctatggatggaacttggttaagctgcattctggtgtggacgtcttttacaaacccacggaacaagtggataccctcctttgtgacataggcgagagctcatccaatccaacaatcgaagaggggagaactctgcgcgtattgaagatggtggaaccttggctgagtagcaagcccgagttctgcattaaagttctcaacccttatatgccaaccgtcatcgaggaattagagaagctgcagaggaaacacggaggcaatcttgtgcggtgtcccctgtctagaaactccacacacgaaatgtactgggtgtcaggtgctagcgggaatattgtctcgtctgttaacactaccagtaagatgctactcaatcgctttacaaccaggcatcgaaaacctacttatgagaaggatgtggacctgggagccggcacgcggtccgtaagcacagagaccgaaaaaccagatatgactatcattggcagaaggttgcagcgcctgcaggaggaacacaaggagacctggcattacgaccaagaaaacccctaccgtacatgggcctatcacgggtcatacgaggcgccgtccacgggatctgctagcagtatggtgaatggtgtcgtgaagctccttaccaaaccttgggatgttatcccaatggtgactcagctggcaatgacagacaccactcccttcggccagcagcgggtctttaaggagaaagtggacacaagaacccctcaaccaaagcccgggacaaggatggtaatgactaccacggccaactggttatgggctctgttgggcaagaagaagaatccgcgcctctgcacccgagaagagttcatatccaaagttcggagcaacgccgcaattggcgccgtgtttcaggaggaacagggttggacatctgcttcagaagcggtcaatgatagtagattctgggagctggtggacaaggagagggccctacaccaagaagggaaatgtgagtcctgcgtgtataacatgatgggaaagcgcgagaagaaacttggcgagtttggcagagcaaaagggagccgggctatctggtacatgtggctgggagccaggttcctcgaatttgaggcactgggtttcttgaacgaggatcattggttcggccgtgaaaattcttggtcgggggtcgagggagaaggcctgcaccgactcggttatatccttgaggagattgacaaaaaggatggggacctgatgtacgccgatgacactgctggatgggatacccgcataacagaagacgatttacagaacgaggaactgatcactgagcagatggcccctcatcacaaaattttggcgaaggcaatctttaaactcacctatcagaataaggttgtgaaggtactgagacccacgccacggggcgccgtgatggacattatctcaaggaaagatcaacgcggcagcgggcaggtcggaacatacggtctaaacaccttcactaatatggaagtgcagcttataagacagatggaggctgagggcgttatcacacaagacgacatgcagaaccctaaggggctgaaagaacgggtggagaagtggctcagggaatgcggagtcgatcgactgaaacgtatggccatttccggcgacgattgtgtggtaaagcccttggacgagagatttggtaccagtttactgttcctcaatgatatggggaaagttcgcaaggacatcccacagtgggaaccctctaagggatggaaaaactggcaggaggtgcctttttgcagccatcacttccacaagatttttatgaaagatggccggtcccttgtcgtgccatgtaggaatcaagacgagctgatcggcagagcacgcatatcacagggggctggatggagtctacgggaaactgcctgcctgggtaaggcttacgcccagatgtggtctctcatgtatttccataggcgagatttgagactggcaagcatggcgatttgttccgccgttccgaccgagtggtttcccacatcacggacgacctggagcatccacgctcatcaccagtggatgactacagaagacatgcttaaagtgtggaacagggtctggatcgaggataatcctaacatgattgacaagaccccagtgcactcttgggaagacataccctacctgggcaagcgcgaggatctctggtgcgggtccttaatcggactgagtagccgtgccacttgggccaaaaatattcatacagctatcacccaagtaagaaacttgattggcaaggaggaatatgtggactacatgcctgtcatgaaacgatattcggccccatccgagtctgaaggtgttctgtga

SEQ ID NO: 15795 - RNA, 9867 nt, synthetic construct
  misc_feature 1..9867: note = derived and/or modified CDS sequence (opt3) from DENV-4__JQ513338__SS-prME
  source 1..9867: mol_type = other RNA
agcaccataactctgctctgccttattcccactgtgatggccttccacctgtccacgagagacggcgaacctttgatgatagtcgctaaacatgaaagggggcggccattactgtttaaaaccacagaaggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggagcagcagtacatttgtagaagggacgtcgttgatcggggctggggcaacgggtgcggattgttcggtaaaggcggggtggtaacatgcgctaagttttcctgttctggaaaaatcactggcaatctcgtgcaaatagaaaacctggagtataccgtcgtggttacagtgcataatggtaacactcctgccgtcgggaatgacaccagcaaccacggcgtgacagcaccaattaccccgcgttccccctcagtagaagttaagttacctgattacggagagctgactctcgactgcgagccacgcagtggcatcgatttcaatgaaatgattcttatgaagatgaaaaagaaaacgtggctggtgcacaagcagtggtttttggacctacccctgccttggacaaccggggctgacactagcgaggtccattggaactacaaagaaagaatggtgaccttcaaggtcccacacgccaaaaggcaggatgtgacagttctcggatctcaggagggtgcgatgcattccgccctggcaggcgctaccgaagtggactcaggggatgagaatcacatgtttgccggacaccttaagtgtaaggtacggatgggcaaactgcgaatcaagggtatgagctatactatgtgcagtgggaaattctctatcgacaaggagatggctgaaacacaacatggcacgaccgtcgtgaaagttaagtacgagggagccggcgcaccctgtaaggtgccgattgaaatacgcgatgtcaacaaagagaaggtggtagggagagtgatctccgccactcctttggctgagaacacaaatagcgttaccaacattgaactcgagcccccattcggagacaggtatatcgtcataggtgtgggcaattcggcgctgacattacactggtttcggaaagggtcttccattggaaagatgttcgaatcaacttaccgcggcgcaaaaagaatggccatcctgggtgagaccgcttgggattttgggagtgtgggcggactattcacgagcctcggcaaggccgtccatcaggtttttgggtccgtgtataccacaatgttcggaggcgtgtcttggatgatcaggattctgatcggttttcttgtattgtggattgggactaacagccgtaatacctcaatggcaatgacatgcatagccgtcggaggcatcactctgttcctcggttttaccgtgcaggctgacatgggctgtgttgtgagttggtccgggcgggaactgaagtgcggaagcggcattttcgtcgtggataacgttcacacgtggacagagcaatacaaatttcagcctgagtctcccgcccgacttgcatcagcgatcctgaatgctcataaggacggggtgtgtggaatcagaagtaccactaggttggaaaacgtaatgtggaaacagattacaaatgagctcaactatgtcctgtgggaaggcggtcacgatttaaccgtggtggccggggacgtcaagggagttctgactaaaggcaagcgcgcactaaccccacccgccagcgacctcaagtactcctggaaaacatggggtaaggctaaaatattcacgcctgaggccagaaattctacctttctgatcgatggcccagacacttcggaatgcccgaacgagagaagggcatggaatagcttcgaggtggaagattacgggttcggaatgtttacaaccaacatttggatgaagttccgcgagggctcctcagaagtatgtgaccaccgacttatgagtgctgccatcaaagatcagaaggcggtgcatgccgacatggggtattggattgagtctagcaaaaatcaaacatggcagatcgaacgggcttccttgatagaggtcaagacttgcctgtggcccaagacccacacgctctggtcaaacggagtgctggagagccagatgttaatccctaaatcttacgcaggcccattttcccagcataactatcgtcaaggttacgccacacagaccgttgggccctggcacctgggaaaacttgaaattgatttcggcgagtgccctggtactaccgtgacaatccaggaaaattgtgaccacagaggcccaagtttgaggactaccacagctagcgggaaactcgtcacgcagtggtgctgtcgctcttgcaccatgcccccgctgcggtttctaggagaggatggctgttggtatgggatggagattagacctctgtccgaaaaggaggaaaacatggtgaaatcacaagttactgccggacagggcacaagtgagaccttcagcatgggtctcctgtgccttactttgtttgtggaagagtgtctgaggcgacgcgtcacacggaagcatatgatcttagcagtagtgataaccctctgcgcgattatcctagggggccttacgtggatggacctgttgagagccctcattatgctgggcgatactatgtcgggcaggatcgggggacagacccacctagctataatggccgttttcaagatgtccccaggttacgtgctgggcgtctttctccgtaaactgacatctcgcgagaccgcacttatggtgatcgggatggctatgactacaaccttgagcattccccatgacctgatggaattaatcgatggaatttcactcggcctgatccttctgaagatagtaacacagttcgacaatactcaagtgggtaccctagccctcagtctgacgtttattcggtccacaatgtctttggtcatggcatggagaaccatcatggccgttctgttcgtggtgactttaatccctctctgtaggaccagctgcctgcagaaacagtcccactgggtcgagattacagctcttatcctgggggcgcaagccttgcccgtgtatctcatgactctgatgaagggagcatcacgacggagctggccactaaacgaaggcattatggctgttggcctggtaagtcttctcgggtctgccctgttgaaaaatgacgtgcctctggccggacccatggtcgctggtggcttactcctggcagcctacgtgatgtccgggagctcggcggatctttcactggagaaggctgccaacgttcagtgggacgaaatggcagatataaccggatctagtccaatcattgaggtgaagcaggacgaggatggctcctttagcatccgcgacgtcgaagagacgaatatgattacattgctcgtgaaactggccctaatcaccgtatctggtctgtacccgcttgctatacctatcactatgacactctggtatatgtggcaggtcaagacccaaagaagcggggcactgtgggatgtgccctccccagccgcgactcagaaagctgccttgtcagaaggagtttacaggattatgcagcggggcttattcggcaagacacaggtgggggtcggaatccatatggagggtgtgttccacaccatgtggcacgttacgcgaggcagtgtgatttgtcatgaaactgggagactggagcccagctgggcagacgtccgcaacgatatgatctcttatggaggcggttggaggctcggggacaaatgggataaggaggaagacgtgcaagtactggccatagagcctggaaagaatccaaaacacgtgcagaccaagcccggcctttttaaaacactgaccggcgaaattggggctgttacattggatttcaagcctggaacttccggttcaccgatcatcaaccgtaaaggcaaggtcattgggctatacggaaatggcgtggtgaccaaaagtggtgactatgtcagcgccataacgcaggcagagcggatcggggagccagactacgaagtagatgaggacatttttagaaagaagaggctgacaatcatggatctccatcccggagctggcaaaactaagcgcattctgccttccatcgtgcgagaagcccttaaaagacggttaaggaccctgatactcgcgccaacacgcgttgtggccgcagagatggaagaggctttgcgtggcctgcccatcagatatcagacccctgccgtcaagtctgagcacactgggcgggaaattgtggacctcatgtgccatgctaccttcacaacgaggctgctttcgagcactcgcgttccgaactacaatctgatcgtgatggatgaggcacactttaccgacccctcatccgtcgccgcccgaggatacattagtacaagagtggaaatgggtgaggctgcggcaatcttcatgaccgccactccacctggcgctacagatccctttccacaatctaacagccctatagaagacattgagcgggagatccccgaaaggtcctggaataccgggttcgattggatcacggactatcagggaaaaactgtatggtttgtgccatcaattaaggccggcaacgatatcgcaaactgcttgcgcaagtctggtaaaaaggttatacagctaagcagaaaaacattcgacaccgagtacccgaagaccaaactgactgactgggattttgtcgtgacaaccgacattagtgaaatgggggccaatttcagggctggccgggtgatcgatcctcgtcgctgtctcaagcccgtcattttaacagacggaccagagcgagttatcctggcgggccccatacctgtgactccagcctccgcagctcaaagaagggggcggattggacgcaaccccgcccaggaagatgaccagtatgtattcagcggtgatcctcttaagaatgacgaggatcacgcacattggacggaggccaaaatgctgctcgacaacatctacaccccggaaggcatcattccaacattgtttgggcccgagagagaaaagactcaggctatcgatggagagttcaggctgcggggcgagcaacgaaaaacctttgtggaactcatgagacgcggtgacctgcctgtctggctttcttataaggtggcctcagcggggatttcctacaaagatagggagtggtgcttcacaggcgaacggaataaccagatactagaggaaaatatggaggttgagatctggacccgtgaaggagagaagaagaaactgagacccaagtggttggacgcaagggtgtatgccgacccaatggctttaaaagattttaaggagttcgccagtggccgcaaaagcattactctggacatcctcacggagatcgcttcgctgcctacctacctttcttcccgggcaaagctggccctcgataacattgtcatgttgcacacaactgaacgagggggacgggcttaccagcatgccctgaatgagctacccgagagcctggaaaccctcatgcttgtagcactgttaggtgcgatgacagccggcatatttttgttctttatgcaggggaagggaatcggcaaactgtcaatgggtctcattaccatcgctgtggccagtgggctgctttgggttgcagagattcaaccacagtggatcgctgcctctataatcctggagttctttctcatggtgttgctgattcctgagccggaaaagcagaggactccccaggacaaccaattaatctatgtcattctaacaatcctgacgataattggcctcatcgcagccaatgagatgggacttattgagaaaaccaagactgatttcggcttttaccaggtgaaaacagaaaccaccatcctggacgtcgatttgcgcccagcttccgcgtggacactgtatgccgtggcaactacgatactcacccctatgctgcggcacacaatcgagaacactagcgctaatctttcactcgccgccattgcaaaccaggctgccgttctgatggggttgggaaagggctggcccctgcacagaatggacttaggtgtgccactactggcgatggggtgttacagtcaggtaaatcctaccacactcaccgctagccttgtgatgctgttggtccattatgccatcattggacccggcctgcaagcaaaagccactcgtgaagctcagaagaggacggcagccggtatcatgaagaacccgacagttgatggcataaccgtgattgacctcgagccaatctcctacgatcctaaattcgagaagcagctggggcaagtcatgcttttagtgctgtgcgcgggacagctcttgctgatgcggactacctgggctttctgtgaagtactaacactggccactggccccatcctcaccctttgggaggggaacccaggacgcttttggaatacaacgattgcagtgtctaccgccaacatcttccgaggcagctatctggctggtgccgggttggcattttccctgatcaagaatgctcagactcccagaaggggaacaggcaccactggtgaaacactcggcgagaagtggaaacggcagctgaactcattagaccgcaaggagttcgaagagtacaagagatctgggattcttgaagttgataggaccgaggccaaaagtgcgctgaaggacggatcgaaaatcaagcacgccgtgagccgaggctcctctaaaattcggtggatcgtcgaacgtgggatggtgaagcctaagggaaaagtcatagacctcggctgcggtagagggggatggtcatactatatggcaacgctaaagaatgtgaccgaggttaaaggctacacaaagggcgggccgggacatgaagaacccatcccaatggctacttatggttggaacctggtaaaattgcacagcggcgtggatgtcttttacaagcctaccgagcaagtggacacactgctctgtgatattggggaatccagttctaatcccactatcgaggaaggacgcacccttagggttctgaagatggtggagccttggttgagctcaaaaccagagttctgcattaaggtcctgaacccctatatgcctacagtgatcgaggagctcgaaaaattacagcggaagcatggcggtaatctggtaagatgtccactttcccgcaacagtacccacgagatgtactgggtgagcggggcctctggaaatattgtttcctcagtcaacactacgagcaaaatgctgctaaataggtttacaacccgacaccggaagcccacttatgaaaaagacgtggatctcggcgcaggcaccagatcggtgtctacagagacggagaagccggacatgaccatcatagggaggcgcctgcagcgtttgcaggaagaacataaggaaacttggcactacgatcaagagaacccttaccggacatgggcttatcatggaagttacgaagccccatccaccggtagcgcctcatccatggtcaatggcgttgtgaaactgctcactaagccctgggacgtaattcctatggtgacacagcttgcgatgaccgatacaactccattcgggcagcagagagtctttaaagagaaggtggacaccaggacgccccaaccgaaacctggaacccgcatggttatgacaactaccgctaactggctgtgggcattactgggcaagaagaaaaatccccgattgtgcacacgggaggagttcatctctaaggtgagaagcaacgccgctatcggtgccgtctttcaggaggaacaggggtggacaagtgcatccgaggccgtgaacgatagcaggttctgggaactcgtagacaaagagcgcgctctgcaccaagagggaaagtgtgaatcttgcgtttataatatgatgggcaaaagagagaagaagctaggcgaatttgggcgggcgaaaggatcaagggccatttggtacatgtggcttggtgcacgtttcctggagttcgaagctctcggctttctgaacgaggaccactggttcgggcgagagaatagttggtccggagtggaaggcgagggtttgcatcgcctggggtatatactcgaagagatcgataagaaagacggagatcttatgtacgccgacgataccgcaggctgggacacgagaattacagaggatgacctgcagaacgaagagttaatcaccgaacagatggccccacaccataagattctggctaaagccatctttaagttgacttatcagaataaggtcgtgaaagtgctccggcctacacccaggggcgcggtcatggatataatcagccgcaaggaccaaagagggtctggacaggttggtacctacggcctgaacactttcaccaatatggaggtgcagctaattcggcagatggaagcagagggggtaatcacacaagatgacatgcagaacccaaaaggacttaaggagagggtggaaaaatggctgcgagagtgcggcgtcgatcgtctcaagagaatggccatttcgggtgacgactgtgtggttaaacccctggatgaacgctttgggacgtcattgttattcctgaatgacatgggaaaggtgcggaaggatatccctcagtgggagccaagcaaaggctggaagaactggcaggaagtcccgttttgctcccaccatttccacaaaatatttatgaaggacggcaggagtctcgtggtaccctgtagaaatcaagatgagcttattgggcgcgctcggatctctcagggagccggttggagcctgagggagaccgcatgcctaggcaaggcttacgcccagatgtggtccctgatgtatttccaccgaagagacctccggttggcttcaatggccatctgtagtgcagttcctactgaatggtttccaacatctaggaccacttggagcattcatgcgcaccatcagtggatgacaaccgaggatatgctgaaggtgtggaaccgcgtctggatagaagacaatcccaacatgatcgataagacgcctgtgcactcctgggaggacattccataccttgggaaacgtgaagatctgtggtgcggatcactcatcggcttaagctctagagccacatgggctaagaatattcacaccgccatcactcaagttcgaaacctgataggtaaagaggagtatgtggactacatgcccgtcatgaagaggtattccgcacctagtgaaagcgagggggtgttgtga

SEQ ID NO: 15796 - RNA, 9867 nt, synthetic construct
  misc_feature 1..9867: note = derived and/or modified CDS sequence (opt3) from DENV-4__JQ513339__SS-prME
  source 1..9867: mol_type = other RNA
agcaccatcactctgctctgccttattcccactgtgatggcattccacctgtccacgagagacggcgagcctttgatgatagtcgctaagcatgaaagggggcggccattactgtttaaaaccaccgagggaatcaacaagtgtactctgattgcaatggatctcggtgaaatgtgcgaggacaccgttacgtacaaatgtccgctgcttgtgaataccgaacccgaggatatcgactgctggtgtaacctgacttctacatgggtgatgtatggaacctgcacgcagtcaggggagcgccgacgtgaaaagcggagtgtggccttgactcctcacagcggaatgggcctcgagaccagggcggaaacatggatgtcctctgagggtgcttggaaacatgcccagcgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactgactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggccacattcaaggtgccccatgcgaaaaggcaggatgtcaccctcctgggatctcaggaaggtgccatgcactccgcacttgctggcgccactgaggtggactcaggggatgaaaaccacatgtttgctggacatctgaagtgtaaggttcggatgggcaaattgcgaatcaagggtatgagctatacaatgtgcagtgggaaattctctatcgacaaggagatggccgagacgcaacacggcaccactgtggtaaaagtcaagtacgaaggagcaggcgccccttgtaaggtgccaattgagatacgcgatgttaataaagaaaaggtggtcgggagagtgctctccgctacacccctggcggagaacaccaacagcgtaacaaatatcgagttagaaccgcctttcggagactcgtatattgtgatcggtgttggcaactctgcactgactctacattggtttaccaaagggtcctcaataggaaagatgttcgagagtacgtacaggggcgccaaacggatggctattctcggtgaaaccgcctgggattttgggagcgtcggcggactgttcacatcccttggcaaggcagtgcaccaggtgtttgggtctgtctatactaccatgttcggaggcgttagctggatgatccgcatcttgattggttttctggtgctctggatcgggacaaattcaagaaacacaagtatggccatgacctgcattgctgtgggaggcataacgctgttccttggttttacagtacaggccgacatgggctgtgtcgtgtcctggagcgggagggagctgaagtgcggatctggcatcttcgttgtggataatgtccatacctggactgaacaatacaaatttcagcccgagtcaccagcacgtttggcgagtgctattctcaacgcccacaaggacggggtgtgtggaatccggagcacaacccgactggagaatgttatgtggaaacagatcactaacgaattaaattatgtgctgtgggagggcggtcacgacctaaccgtagtcgcaggggatgtgaagggagtgctcacaaaaggcaagagagccctgacgcctcccgcttccgaccttaagtactcttggaaaacctggggtaaggccaaaattttcactccagaagcaaggaactcgacatttttgatagatggccccgacaccagcgagtgccctaatgaacgccgggcttggaactccttcgaggtcgaggattacgggttcggaatgtttacaactaatatctggatgaagttcagagaaggctcaagtgaggtttgtgaccataggctgatgtctgccgcgattaaagatcagaaggccgtgcacgctgacatggggtattggatcgaaagctccaaaaaccaaacctggcagattgagcgcgcatcactcatcgaagtaaagacgtgcctgtggccaaagacacataccttatggagcaatggagtgctggagtctcagatgcttataccgaaatcctacgccggcccctttagtcagcacaactatcgacaaggttacgctactcagaccgtcgggccttggcacttgggaaagctcgagatcgatttcggcgaatgcccaggtacaactgtgaccattcaggagaactgtgaccatcggggccccagcctgcgtacaacgaccgcctctgggaagttagttactcagtggtgctgtagatcctgcacaatgcctccactgaggtttctcggagaagatggctgttggtatgggatggagatccgccccctgtcagagaaggaagagaatatggtgaaaagtcaagtcaccgcaggacagggcactagcgaaacattctcgatgggtcttttgtgcctgaccttatttgtggaggaatgtctccggagaagggttacgcgaaagcacatgattctggcggtggtcatcactctttgcgccataattctagggggcttgacctggatggacctcctgcgcgctctaatcatgctgggcgatacaatgtccggccggattgggggacagacccatctcgccatcatggcagtattcaagatgtctccgggttacgtgctgggcgtttttcttagaaaattgactagcagggagacagctctgatggtgatagggatggccatgaccacaactttatcaatccctcacgacctcatggagctgattgacggaatcagtcttggcctgattctactcaagatcgtcacccagttcgataacacgcaagtgggtacactggcattgtccctgacctttatacgttctactatgagcttagtaatggcctggcgcaccattatggctgtactcttcgtcgttacactgatcccactttgtcggacttcctgcctgcagaaacagtcacattgggtggaaatcaccgcgttgattctcggggcccaagcactgcccgtgtatctaatgacgctgatgaagggagctagcagaaggagttggcctcttaatgagggcatcatggccgtcggcctcgtgtctctgttggggtccgccctgctcaaaaacgacgttcccctagctggaccaatggtagccggtggcctgcttctggccgcgtacgtgatgagcgggtcgtcagctgatttgtctctcgaaaaggccgcaaatgtccagtgggacgagatggccgatattacaggaagttcccctataatcgaagtgaagcaggacgaggatggcagcttttctattcgagacgttgaggaaaccaacatgatcactctgctagtgaaactggctcttattacagtcagcggtctctaccccctggcaatcccaataaccatgactttgtggtatatgtggcaagtgaagacacaacggtccggggccttatgggatgtaccgagccctgcggctacccagaaagccgcactgagtgagggagtctaccgcatcatgcagagaggcctcttcggcaagacacaggtgggggttggcattcacatggaaggtgtgttccacactatgtggcatgtcaccaggggcagcgtgatctgtcacgagacagggcggctggaaccctcttgggccgacgttcgaaatgatatgatttcctatggaggcggttggagacttggggacaaatgggataaggaggaggacgtgcaagtcctggctatcgaaccaggaaagaaccccaaacatgtgcagaccaagcctggcttgtttaaaacactaactggcgagataggggccgtaaccctggacttcaagccaggaacgtcaggtagtcccattatcaatcgcaaaggcaaggtgatcgggctctacggaaacggcgttgtcacaaaaagcggtgattatgtgtccgcaattactcaggctgaaaggataggggagcctgactacgaggtggatgaagacatctttcgtaagaagcggctgaccattatggatcttcacccgggagccggcaaaacaaagagaatcttaccatctattgtcagggaggcgctgaaacgccgactcagaaccttgatcctggcccccactcgggtagtggcagctgaaatggaggaagccctcaggggcctgcctatacgctatcagaccccagctgttaagtcggagcatacagggcgtgagatcgtggaccttatgtgccacgcaacgttcactaccagactgttgagctcaacacgggtccccaattacaacctaattgtgatggatgaagcccactttaccgacccttccagtgttgccgctaggggatacatctctactcgcgtggagatgggtgaagcggcagccattttcatgacagctaccccgcccggcgccacggatccatttcctcaaagcaattcccccatcgaggacatagaacgagagattccagagagatcatggaacactgggttcgattggatcacagactatcagggaaaaaccgtctggtttgtgccttctatcaaggcaggcaatgacattgccaactgcctgcggaaatcaggtaaaaaggtaatccagctcagtaggaaaaccttcgatactgaataccccaagacaaaattaaccgactgggattttgtggttacaactgacatatccgagatgggggctaacttccgcgcgggcagagtcattgatccaaggcggtgtctgaagccggtgatccttacggacggacctgaacgtgtgattctggccggccccatcccagtcacccccgcaagcgctgcccaacgccgagggagaataggaaggaatcctgcacaggaggatgaccagtatgttttctctggtgatccactcaagaacgacgaagatcatgcccactggacagaggctaaaatgttgctggacaatatttacactcccgagggcatcatccctaccctctttgggccggaacgggagaagacacaggccattgatggagagttccgcctgagaggcgagcaaaggaaaacctttgtggagcttatgcggcgaggtgacctaccagtatggctgtcatataaggtggcgtccgcagggatcagttacaaagacagagaatggtgcttcactggcgagcgcaacaatcagattttggaagagaacatggaagtcgagatatggacgagggagggagaaaagaagaaattacggcccaagtggctggatgcccgtgtgtatgctgaccctatggccctcaaagattttaaggagttcgctagcggcagaaaatcgatcaccctggacattcttacagaaatcgcatctctgcccacttacctctccagcagggccaagttggctctggataatatcgttatgctacataccacagagcgcgggggacgggcctaccagcacgcactgaacgaactcccagagtcacttgagaccctgatgttagtggcgttgctgggtgccatgactgctggcatttttctcttctttatgcaggggaagggaataggcaaactgagtatgggtcttatcacaattgccgtcgcatctgggctgctctgggtagctgaaatccaacctcagtggattgccgcatccatcatattggagttctttctgatggtgttactaatccccgaaccagagaagcagcgaacgcctcaggacaatcaactgatttatgttatcctcaccattcttactatcataggcctgattgccgctaacgaaatgggattgatcgagaaaacaaagaccgatttcggcttttaccaggtgaaaaccgagacaactattctggacgtcgatctcagaccggcgagcgcctggacgctgtatgcagtggctaccacaatccttactcccatgctcaggcacaccatagaaaatacatcagccaacctgagtttggccgcaatcgctaatcaggccgcggtcctgatggggttaggaaagggctggccactacatcgcatggacctgggtgtgcctctccttgctatggggtgttacagccaggttaaccccaccactctgacggcctccttggtgatgctgctcgtacactatgcaattatcggaccaggcctgcaagccaaagctacacgggaggcacagaagagaaccgccgcgggtattatgaagaatcctactgtggatggcatcaccgtcatagaccttgaacccatttcttacgatccgaaattcgagaagcagttagggcaagttatgctgctcgtgttgtgcgctggacagctgctactgatgcgtacaacttgggccttctgtgaggtcctcacccttgcaacaggcccaatcctgacgttgtgggaagggaaccctggaaggttttggaacaccactatcgccgtgagcacagctaatattttccggggctcctatctggccggtgcagggctcgctttttcactgatcaaaaacgcccagacaccccgccgaggaactggcacaaccggtgagacgttaggcgaaaagtggaaaagacagcttaattctctggacaggaaggagttcgaagagtacaagcggagtgggatactcgaggtagaccgcaccgaagcgaaatcggccctaaaggatggaagcaaaattaagcatgcagtgtccagaggatcttcaaaaatcaggtggattgttgagcgagggatggtgaagccaaagggaaaagtcatcgacctgggctgcggtagagggggatggagctactatatggctacattgaagaacgtgactgaagtcaaaggctacaccaagggcgggcccggacacgaggaacctataccgatggccacatatggttggaatctggtgaaactccattccggcgttgatgtattttacaagcccactgagcaagtggacacccttctgtgtgatatcggggagagttctagcaacccaacaattgaagagggacgtaccttgagagtcctgaagatggtggaaccttggctctcatccaaacccgagttctgcatcaaggttttaaatccttatatgccaactgtgattgaagaactggagaaacttcagcgcaagcacggcggtaacctggtcaggtgtcccctaagtcggaatagcacgcacgaaatgtactgggtgtctggggcatccggaaacatcgtatcaagcgtgaatacaacctcgaaaatgctcctgaacagatttactacccgccataggaagcctacatatgagaaagacgttgatttgggcgctggcacgcgatctgtcagtaccgaaactgagaagccagacatgacaattatcgggcggagactgcagaggctccaggaggaacacaaggagacctggcattacgatcaagaaaatccctaccgcacttgggcctatcacggatcctacgaggccccgagcacaggttcagcgtcctctatggtgaacggcgtggtcaaacttctgaccaagccttgggacgttataccaatggtgacacagttagctatgactgataccacgcccttcgggcagcagcgtgtatttaaagaaaaggtggacacccggacacctcaaccaaaacccggaactagaatggtcatgaccacaactgcaaattggctgtgggccttgctcggcaagaagaaaaacccgaggctgtgcacccgcgaggagttcattagcaaggtgcgaagtaatgctgccatcggtgcagtttttcaggaagaacaggggtggacgtccgccagcgaagctgtgaacgactctcggttctgggagctagtcgataaagaaagagcgcttcaccaagagggaaagtgtgagtcatgcgtgtataacatgatgggcaaaagggaaaagaagctgggcgagtttgggcgcgccaaaggaagtagagcaatctggtacatgtggctcggtgctcggttcctggagttcgaggccttgggctttctgaatgaagaccattggttcgggagggagaactcctggagcggagtagagggcgaaggtctccaccgtcttgggtatattctggaggaaatagataagaaagacggagatttaatgtacgcagacgatacagccggctgggacacccgaatcactgaggatgacctgcagaatgaggaattgattacagagcagatggctcctcatcacaagatcctcgccaaagcgatttttaagctgacctatcagaacaaggttgtgaaagtcctacgccccactccaagaggcgcagtgatggatatcatatctcggaaggaccaaagggggtcgggacaggtgggtacctacggccttaatacattcacgaacatggaagtccagctgatccgccagatggaggccgaaggggttattacccaagatgacatgcagaatcctaaaggactcaaggagagagtggagaaatggctgcgggaatgcggcgtagacaggttgaagcgaatggctatctcaggtgatgactgtgtggtcaaacccttagatgagcgttttgggactagcctactcttccttaacgacatgggaaaggtgagaaaggatattccacagtgggaaccctccaaaggctggaagaattggcaggaggttcctttttgcagtcatcacttccacaaaatctttatgaaggacggccgctctctggtggtcccatgtcggaaccaagatgaactaatagggagggccagaattagccagggagcaggttggtccctgcgcgagacagcttgcctcggcaaagcctacgctcagatgtggtcattgatgtatttccatcggagggacctgcgacttgccagtatggcaatctgttctgcggtgccgaccgagtggtttcccactagcagaacaacctggtccatccacgcccatcaccagtggatgacgacagaagatatgctgaaggtatggaatcgggtttggattgaggacaaccctaatatgatagataagaccccagtgcactcatgggaagacatcccctacctcgggaaaagggaggacttatggtgcggaagcctgattggcttgtcttcccgcgctacttgggccaagaacatccataccgcaattacacaagtccgtaatctgatcggtaaagaagagtatgtggattacatgcctgttatgaagagatatagtgctccaagcgagtcggaaggggtgctctga

SEQ ID NO: 15797 - RNA, 9867 nt, synthetic construct
  misc_feature 1..9867: note = derived and/or modified CDS sequence (opt3) from DENV-4__JQ513343__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggaaacattcaaggtgccccatgccaaaaggcaggatgtcaccctcctgggatctcaggagggtgcgatgcactccgcccttgcaggcgctactgaagtggactcaggggatgagaaccacatgtttgccggacatctgaagtgtaaggttcggatggagaaattgcgaatcaagggcatgagctatacaatgtgcagtggtaaattctctatcgacaaggaaatggctgagacgcaacacgggaccactgtggtaaaagtcaagtacgaaggcgccggagcaccttgtaaggtgccaattgagatacgcgatgttaataaagagaaggtggtcggcagagtgatctccgccacacccctcgctgaaaacaccaacagcgtaacaaatattgagctggaaccgcctttcggggactcgtatatcgtgataggagttggtaactctgcgttaactctgcattggtttaggaaaggctcctcaattgggaagatgttcgagagtacctaccggggagcaaaacgcatggccatcctaggcgaaacggcttgggattttggtagcgtcgggggcctcttcacctccctgggaaaggccgtgcaccaggtgtttggctctgtctatacaactatgttcgggggagttagctggatgatcagaattcttatcggctttttggtgctgtggattggtaccaattcaaggaacacaagtatggcaatgacttgcatagccgtggggggaatcaccctcttcctgggctttacggtacaggctgacatgggttgtgtcgtgtcctggagcggccgtgagcttaagtgcgggtctggaattttcgttgtggataatgtccatacatggaccgagcaatacaaatttcagcccgaatcaccagcccggctggcaagtgcgatcttgaacgctcacaaggacggcgtgtgtgggatccgaagcactacaagactcgagaatgttatgtggaaacagattaccaacgaactgaattatgtgttatgggagggaggccacgacctgactgtagtcgccggtgatgtgaagggggtgctaaccaaaggaaagagggcactcacacctcccgcctccgacctgaagtactcttggaaaacgtggggcaaggctaaaatattcaccccagaagcccgcaactcgacttttcttatcgatggtcccgacacaagcgagtgccctaatgagcggagagcatggaactccttcgaagtcgaggattacggcttcgggatgtttaccacaaatatttggatgaagttcagggaaggatcaagtgaggtttgtgaccatcgcttgatgtctgctgccatcaaagatcagaaggcggtgcacgccgacatgggctattggattgaaagctccaaaaaccaaacttggcagatcgagcgagcttcactgatagaggtaaagacctgcctctggccaaagacgcatacactgtggagcaatggggtgttagaatctcagatgctgatcccgaaatcctacgcaggaccctttagtcagcacaactatcggcaaggctacgccacccagactgtcggtccttggcaccttgggaagttggagattgatttcggagaatgcccaggcaccacagtgactatccaggagaactgtgaccatcgtggtcccagcctcagaaccacaacggcttctggcaaactggttacccagtggtgctgtaggtcctgcactatgcctccactacgctttctgggggaggatggatgttggtatggcatggaaattcggcccctctcagagaaggaagagaatatggtgaaaagtcaagtcacagccgggcagggaaccagcgaaactttctcgatgggcctgctttgcttgacactgtttgtggaggagtgtttaagaaggcgagttacccgcaagcacatgatcctcgcagtggtcataacgctgtgcgcgattatccttggtgggctgacttggatggacttgctccgggccctgattatgctaggagataccatgtccggcagaatcggcgggcagacacatctggctataatggccgtattcaagatgtctccgggatacgtgctcggtgtttttctgaggaaacttaccagccgtgaaactgcattgatggtgatcggcatggctatgacaaccacactgtcaattcctcacgacttaatggagctcatcgacgggattagtctgggacttatcctgctaaagatagtcactcagttcgataacacccaagtgggcacgctcgccctgtccttgacatttattcgctctaccatgagcctggtaatggcatggcggactatcatggccgtgttattcgtcgttaccctcatcccactgtgtagaacatcctgccttcagaaacagtcacattgggtggaaattactgctctgatcttgggtgcgcaagccctccccgtgtatctgatgaccctaatgaagggggcaagcaggcgaagttggcctctgaatgagggaattatggctgtcggccttgtgtctctcctgggctccgccttgctgaaaaacgacgttcccttagccgggccaatggtagctggaggtctcctgcttgcagcctacgtgatgagcggctcgtcagcggatctgtctttggaaaaggctgccaatgtccagtgggacgagatggcagatataacggggagttcccctatcattgaggtgaagcaggacgaagatggaagcttttctatccgggacgttgaggaaacaaacatgattaccctcctggtgaaactagccctgatcactgtcagcggcctttaccccctcgctataccaatcacaatgaccctgtggtatatgtggcaggtgaagactcaacgctccggtgcattgtgggatgtaccgtcacctgccgcgacacagaaagctgccttaagtgagggggtctacagaattatgcagaggggactgttcggcaagacccaggtgggcgttgggatccacatggaaggagtgttccacacgatgtggcatgtcactcggggtagcgtgatttgtcacgagaccggccgactcgagccctcttgggcagacgttagaaatgatatgatctcctatgggggaggctggcgcctgggtgacaaatgggataaggaagaggacgtgcaagtccttgccatagaaccagggaagaaccccaaacatgtgcagacaaagcctggactgtttaaaaccttgacaggcgagattggcgctgtaactctagacttcaagccagggacctcaggaagtcccatcatcaataggaaaggtaaggtgattggcctgtacgggaacggagttgtcacgaaaagcggcgattatgtgtccgccataacacaggcagagcgtatcggtgaacctgactacgaggtggatgaagacatttttcggaagaagagactcactatcatggatctgcacccgggggctggaaaaaccaagaggattcttccatctatcgtccgcgaggccttaaaacgaagactgcggacactcatattggcgcccaccagggtagtggccgcagaaatggaggaggctctgcgcggcctccctatccgttatcagactccagccgttaagtcggaacataccggcagagagattgtggacctgatgtgccacgctacattcacgactcggcttctgagctcaaccagggtccccaattacaacttgatcgtgatggatgaagcacactttacagacccttccagtgttgccgcccgcgggtacatttctacccgagtggagatgggagaagctgcggcaatcttcatgactgccacaccgcccggtgctaccgatccatttcctcaaagcaattcccccatagaggacattgagagagaaatcccagagcggtcatggaacacgggcttcgattggatcactgactatcaggggaaaacagtctggtttgtgccttctattaaggccggaaatgacatcgcaaactgcctaaggaagagcggcaaaaaggtaatacagctgagtcgcaaaaccttcgataccgaataccccaagactaaactcacagactgggattttgtggttaccacagacatttccgagatgggtgccaacttcagagctgggagggtcatcgatccacggcgttgtttaaagccggtgattctgactgacggccctgaacgcgtgatccttgcgggacccataccagtcacgcccgccagcgcagctcaacgaagaggcaggattgggcggaatcctgcccaggaggatgaccagtatgttttctctggagatccactgaagaacgacgaggatcatgcacactggaccgaagccaaaatgctcttggacaatatctacacacccgagggtatcattcctactctgtttggcccggaacgcgagaagacccaggctatcgatggggagttcagactcaggggagaacaacggaaaacatttgtggagctgatgcgaagaggcgaccttccagtatggctatcatataaggtggcctccgcgggtattagttacaaagaccgcgaatggtgcttcaccggggagaggaacaatcagatactggaagagaacatggaggtcgaaatctggactcgggagggcgaaaagaagaaattgcgtcccaagtggttagatgcaagagtgtatgccgaccctatggctctgaaagattttaaggagttcgccagcggaaggaaatcgattacgctcgacatcctgaccgaaatcgcttctcttcccacatacctgtccagccgcgcaaagctcgccttggataatattgttatgctgcatactaccgagcggggcgggcgagcttaccagcacgccctaaacgagctgccagaatcactcgagacacttatgctggtggcattattgggagcgatgaccgccggtatatttctgttctttatgcagggcaaggggatcggaaaactcagtatgggcctgattactatcgctgtcgcctctggtcttctgtgggtagcagaaattcaacctcagtggatcgctgcctccataatcctcgagttctttttgatggtgctgttaattcccgaaccagagaagcagagaacacctcaggacaatcaactaatctatgttattctgacgatcctcaccataattgggcttatcgcagccaacgagatgggcctgattgaaaaaactaagacagatttcggattttaccaggtgaaaaccgagaccacaatcttggacgtcgatctgaggccggctagcgcgtggactctctatgccgtggcaacgaccatactgacacccatgcttcgccacactatcgaaaatacctcagctaacctcagtctggccgccattgcaaatcaggctgccgtcttgatgggcctggggaagggatggccattacatcggatggacctaggcgtgcctctgctcgcgatgggttgttacagccaggttaaccccacaacccttactgcttccctggtgatgttgctggtacactatgccatcattgggccaggactccaagcaaaagccacgagagaggctcagaagcgtacagcagccggcatcatgaagaatcctaccgtggatggtataactgtcattgacctggagcccatctcttacgatccgaaattcgaaaagcagcttggccaagttatgttactggtgctctgcgcggggcagttgctgctaatgaggaccacatgggctttctgtgaggtcctgactctcgccaccggaccaatccttacactgtgggaaggcaaccctgggcggttttggaacacgaccattgcagtgagcactgccaatatcttccgcggatcctatttggctggcgccggtctggcattttcactcataaaaaacgctcagacaccccgaagagggaccggaactacaggcgagaccctgggtgaaaagtggaaaaggcagttaaattctcttgaccggaaggagttcgaggaatacaagcgcagtggcattctggaggtagacagaacggaagccaaatcggcgctcaaggatgggagcaaaatcaagcatgccgtgtccaggggatcttcaaaaattcgatggatcgttgagcggggcatggtgaagccaaaggggaaagtcatagacctaggatgcggccgtggtgggtggagctactatatggcaaccctgaagaacgtgacagaagtcaaaggatacactaagggcggccccgggcacgaggagcctatcccgatggctacctatggatggaatttggtgaaactgcattccggtgttgatgtattttacaagcccacagaacaagtggacactctcctttgtgatattggcgagagttctagcaacccaaccatcgaagaggggagaacactgcgcgtcttgaagatggtggaaccttggctgtcatccaaacccgagttctgcattaaggttctcaatccttatatgccaaccgtgatcgaggaattagagaaactgcagaggaagcacggaggcaaccttgtccggtgtcccctgagtagaaatagcactcacgaaatgtactgggtgtctggtgcctccgggaacattgtatcaagcgtgaatacgacatcgaaaatgctactcaaccgctttaccactaggcatcgaaagcctacctatgagaaagacgttgatctgggagcaggcacacggtctgtcagtacggagaccgaaaagccagacatgactatcataggcagaaggttgcagcgcctgcaggaggaacacaaggagacatggcattacgatcaagaaaatccctaccgtacctgggcttatcacgggtcctacgaggccccgagcactggatcagcctcctctatggtgaacggtgtggtcaaactccttacaaagccttgggacgttattccaatggtgacccagctggcgatgacagatactacccccttcggccagcagcgggtatttaaagagaaggtggacacgagaacccctcaaccaaaacccgggacaaggatggtcatgactaccacagctaattggttatgggcactgttgggaaagaagaaaaacccgcgcctctgcactcgagaagagttcatcagcaaggtgcggagtaatgccgctatcggcgccgtttttcaggaagagcagggttggacctccgcaagcgaagccgtgaacgactctagattctgggagctggtcgataaagagagggctctacaccaagaagggaagtgtgagtcatgcgtgtataacatgatgggaaaacgcgaaaagaagcttggcgagtttggcagagcgaaagggagtcgggccatttggtacatgtggctgggagcaaggttcctcgaattcgaggctctgggttttttgaatgaggaccattggttcggccgtgaaaactcctggagcggggtagagggagaaggcctgcaccgactcggttatatacttgaggagatcgataagaaagacggggatctgatgtacgccgacgatacggcaggatgggacacacgcattaccgaagatgacttacagaatgaggaactgatcactgagcagatggcccctcatcacaagattttggctaaagccatctttaagctcacatatcagaacaaggttgtgaaagtcctgagacccaccccacggggcgcggtgatggatataatctctaggaaggaccaacgcggctcggggcaggtgggaacttacggtctaaataccttcacaaacatggaagtccagcttattagacagatggaggcagagggcgttatcacgcaagatgacatgcagaatcctaaagggctgaaggaacgggtggagaaatggctcagggaatgcggagtagaccgactgaagcgtatggccatttcaggcgatgactgtgtggtcaaacccttggatgagagatttggtaccagcttactgttcctcaacgacatggggaaggtgcgcaaggatatcccacagtgggaaccctccaaaggatggaagaattggcaggaggttcctttttgcagtcatcacttccacaaaatatttatgaaggacggccggtctcttgtggtcccatgtaggaaccaagatgagctgattggcagagctcgcatcagccagggggccggatggtccctacgggaaactgcatgcctgggtaaagcttacgcccagatgtggtcactcatgtatttccataggcgagacttgagactggctagtatggccatctgttctgcagtgccgacagagtggtttcccaccagccggactacatggtccattcacgcgcatcaccagtggatgaccacggaagatatgcttaaggtatggaatagggtttggatagaggacaaccctaatatgatcgataagacaccagtgcactcatgggaagacattccctacctgggcaaacgcgaggacctctggtgcgggagcttaatcggactgtcttcccgtgccacctgggctaagaacattcatactgccatcacccaagtcagaaatttgataggcaaagaggaatatgtggattacatgcctgttatgaagcgatatagtgcaccaagcgagtcggaaggtgtgctgtga

SEQ ID NO: 15798 - RNA, 9867 nt, synthetic construct
  misc_feature 1..9867: note = derived and/or modified CDS sequence (opt3) from DENV-4__KT276273__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggcgccctacgctggattttgaactaactaagacaaccgccaaggaggtggcgctcctgcgaacttactgtatcgaagcaagtatttccaatatcacaaccgccacgagatgcccaacccaaggagagccctatcttaaagaggaacaggaccagcagtacatttgtaggcgggatgtcgttgaccgtggctggggcaacgggtgcggactgttcggtaagggcggggtggtaacatgcgctaaattttcttgtagcggaaagatcactggcaatttggtgcaaatagagaacctcgaatataccgtcgtggttacagtgcataatggtgatactcacgccgtcgggaacgacacctccaatcacggcgtgacagcaaccattactcctcgctcaccaagtgtagaggttgaactgccggattacggagagttaacgctggactgcgagcccagaagcggcatcgacttcaacgaaatgattctcatgaaaatgaataagaagacatggcttgtgcataaacagtggtttctggatttgcctctaccatggaccgctggggccgacacttctgaggtccactggaacaataaggaaaggatggtgaccttcaaagtcccccatgcgaagcggcaggatgtgacagttctgggatcccaggagggtgccatgcactcagcactcgctggcgccaccgaagtggacagcggggatggaaaccacatgtttgctggccatctgaaatgtaaggtacgaatggagaaacttcgcatcaagggtatgagttacactatgtgctctgggaagttctccatcgacaaagagatggccgaaacacaacacggcacgaccgtcgtgaaggttaaatatgagggagcaggcgccccttgtaaggtgccaattgaaataagagatgtcaacaaagagaaggtgatcgggagggtaattagctcgatccccctggctgagaatactaactctgtgacaaatatagaattggagccgcctttcggagactcctacattgttatcggtgtcggcaactcagcgctcaccctgcattggtttcggaaggggagtagcatcggaaaaatgttcgaatccacatatcgcggcgcaaagagaatggccattttaggtgagactgcttgggattttgggtctgtgggcggactgttcaccagcctaggcaaagccgtgcaccaggtctttgggtcagtttacacgaccatgttcggaggcgtgagttggatgatcaggattctcataggttttctggtgctttggatcgggacaaattcccgtaacactagcatggcaatgacctgcattgccgtaggaggcatcacattgttcctgggttttactgtccaggctgacatgggctgtgtggtttcttggtcagggcgggaactcaagtgcggaagtggcatcttcgtgattgataatgtccatacctggacggagcaatataaatttcagcccgagagcccagcccgactggcatccgcgatacttaacgctcacaaggacggggtgtgtggaatcagatctacaaccaggctggaaaatgttatgtggaagcagattactaacgagttgaattacgtgctctgggaaggcggtcacgacctgacagtagtcgccggggatgtgaaaggagtgttaaccaagggcaaacgcgcactgactcctcccgcctcggacctaaagtatagctggaaaacctggggtaaggctaagatcttcacaccagaggcccggaactccacgtttctcattgatggccccgacacctcagaatgccctaatgagagaagggcatggaacagtctggaggtcgaagattacgggttcggaatgttcactacaaatatctggatgaaatttcgcgagggctctagcgaaatgtgtgaccatcgacttatgtccgctgccataaaggatcagaaagcggttcacgccgacatggggtactggatcgagtcaagcaagaaccaaacctggcagattgaaaaagcttctttgatcgaggtgaagacatgcctgtggccaaaaactcataccctctggtccaacggagtactggagagtcagatgttaattccgaagagctatgcaggccccttctctcagcacaattaccggcaaggttatgccacgcagatcgctgggccttggcacctgggaaagcttgaaatagattttggcgagtgcccaggtacaaccgtgactattcaggaagactgtgatcatcgtggcccctccttgagaaccacaactgcctcagggaaactcgtcacccagtggtgctgtaggagttgcacaatgcctccactgcgcttcctaggagaggacggctgttggtacgggatggagatccggcccctgagcgaaaaggaggaaaacatggtgaaatcgcaagttgcagcgggacagggcacgtccgagaccttttctatgggtctcctgtgccttactttgttcgtggaagagtgtctgagaaggcgagtcacacgcaagcacatgattttagtggttgtgatcaccttttgcgccataatcctcgggggactgacttggatggatcttctgcgggctttgattatgctcggcgacacaatgagcggcagaatcgggggacagattcatctggccatcatggcagtcttcaaaatgtcaccgggttatgtactaggcgtgtttctgaggaagctcaccagtcgtgagacggctctgatggttatagggatggccatgactaccgtgctttccattccttacgacttgatggaactgatcgatggaatctctttaggcctcattctgcttaagatcgtcacacagttcgacaatacccaagtgggtactctggcactaagcctcacatttattcgctccaccatgccactggtaatggcctggcggacaataatggctgtgttgttcgtcgttactctgatccccttatgtagaacctcatgcctccagaaacagagccactgggtggagattacggcgctgatccttggggcccaagcactgcctgtgtatttgatgacactcatgaagggagctagtaggcgatcttggcccctgaacgaaggcattatggccgtcggcctagtgtccctgcttgggagcgccctcctgaaaaatgatgttccattggctggacctatggtagcaggtggcctgttactcgccgcgtacgtgatgtcggggtcatctgctgacctgagtcttgagaaggccgcaaacgtccagtgggatgaaatggccgacatcaccggatccagccccataatcgaggtgaaacaggatgaggacggctcttttagcattcgggatgttgaagagactaatatgatcaccctgttggtgaagctcgctctgattacagtctccggtctatacccactggcaatcccggtgactatgaccctttggtatatgtggcaggtaaagacgcaacgctcaggggccctctgggacgtccctagtcccgcggctacacagaaagccgcactgagcgaaggagtgtacagaataatgcagaggggcttgttcggcaagacccaggttggggtgggaattcatatggagggtgtcttccacactatgtggcacgtgacacggggctctgttatctgtcatgaaaccgggcgattagagccatcctgggccgatgtgagaaacgacatgatctcatatggaggcggttggcgcctgggggataaatgggacaaggaggaagacgtccaagtgctcgctattgagcccggaaaaaatcctaagcacgtacagactaagccaggcctgtttaaaacacttaccggcgaaataggggccgtgacgctggatttcaagcccggaactagtggtagccctatcattaacaggaaaggcaaggttatcgggttgtacggaaatggcgtcgtgaccaaatccggtgactatgtgtctgcaattacacaggctgagcgtatcggggagccggattacgaagtcgacgaggatatatttcggaagaaaagactaaccatcatggacctgcatccaggagccggcaagacaaagaggattctcccctcgatcgtacgcgaagcgctgaaacgaagacttcggactttaattctggcccctaccagggtggttgcagctgagatggaagaggccctccgcggcttgccaatccgttatcagacgcccgctgtgaagagcgagcacacagggagagaaatagtcgatctgatgtgccatgcaactttcaccacacggctcctgtcatccaccagggtgcctaactacaatcttattgttatggacgaggcccactttactgatccgagttctgtggccgctcgcggatacatcagcacccgagtcgaaatgggtgaggcggcagccatcttcatgacagctacgcccccaggcgccactgacccttttccccaatccaactcaccaattgaagatatcgagagagagatacctgaacggtcttggaataccgggttcgactggattacagactatcagggaaaaaccgtgtggtttgtacccagcatcaaggcaggcaacgatattgccaactgcctgaggaaaagtggtaagaaggtgatccagttgtcccgcaaaactttcgacacagagtacccaaagaccaaactaacggattgggactttgttgtcactacagatataagcgaaatgggggctaatttcagagcgggcagggtgattgacccgcggcgttgtctgaagcctgtgatcctcaccgatggacccgagcgcgtcatcttagccggcccaattcccgttacccctgcatctgctgcccaacgaagagggaggatcggacggaacccagcacaggaagacgatcagtatgtgttctcaggtgaccccctgaaaaatgatgaggaccacgcccattggactgaggctaagatgcttctggataacatttacacacctgaaggcataatcccgaccctctttgggccagagcgcgaaaagacacaggccattgacggagagttcagattgaggggcgagcaacggaaaacttttgtagaactgatgcgaagaggtgacctccccgtgtggctgtcctataaggtcgcgagtgcagggatcagctacaaagatcgcgagtggtgcttcacgggcgaaaggaataaccagatccttgaggaaaatatggaggtggagatttggacccgggaaggagagaagaaaaagctacgtcctagatggctggacgccagggtttatgctgatcccatggccttgaaggactttaaagaattcgcttcgggccgcaagtctataacattagatatcctgactgagattgcatccctcccaacctacctgagctcacgggccaaacttgctctggacaacatcgtgatgctccacacaaccgaacgagggggaagagcctaccagcatgcattgaatgagctgcctgagagtctagaaactctgatgctcgtcgcgcttctgggtgccatgacggctggcatttttttattctttatgcaggggaagggaatcggcaaattgtctatgggtctgataaccatcgccgtagcatccgggctcctgtgggtggctgagattcaaccccagtggatcgccgcaagcattatccttgaattctttctgatggttctcttgataccagagcctgaaaagcagaggacaccgcaggataaccaactgatttatgtgatcttaactattctaaccatcataggcctgatcgccgctaatgagatgggactcattgagaagacaaaaaccgacttcggcttttaccaggtcaagactgaaacaacgatccttgatgtggacctgcgccccgcgtcagcctggaccttgtatgcagtcgctactacaattctgaccccaatgctccggcacaccatcgagaacacaagtgccaatctgagccttgccgcaatagctaaccaggccgcggtgctcatggggctgggaaaaggctggcctttgcacagaatggatctgggtgttcccttactagctatggggtgttactcccaggtgaatccaactacgctgaccgcctctctcgtaatgcttctggtgcattatgcaattatcggacctggcttgcaagccaaggctacacgtgaagcacagaaaaggactgccgcgggtatcatgaagaaccccaccgtcgacggcattacagttatcgatctggagccgataagctacgacccaaaattcgagaagcagctcgggcaagtgatgctgcttgtcttatgcgctggacagctgctcttgatgcggaccacttgggccttctgtgaagtgctgacgctagcaacaggccctattctgaccctctgggaggggaaccccggacgcttttggaatactaccatcgccgtatccacagctaacattttccgaggctcatatcttgccggtgcagggctggctttttctttgatcaagaatgcccagactccaagaaggggaaccggcacaacgggtgaaaccctgggcgagaaatggaagcggcagctcaacagtctggaccgcaaagaattcgaggagtacaagagatcggggatattagaagtggataggactgaggcgaaaagcgcccttaaggacggatccaagatcaaacacgcagtttctcgaggctcaagcaagattcggtggatcgtggaacgtgggatggtcaaacccaagggaaaagtggtcgatctgggctgcggtagagggggatggtcctactatatggctacactcaagaatgtgaccgaggttaagggctacactaaaggcgggcctggacatgaagagccgattcccatggccacatatggttggaacctagtaaagctgcacagtggcgtggacgtcttttacaaaccaaccgagcaagtggatacgttgctgtgtgacatcggggaatctagctcaaatcctaccattgaggaaggacgcacactcagggttcttaagatggtggagccctggctgtccagtaaacctgaattctgcatcaaggtcttgaacccatatatgcccactgtgatagaggagctggaaaagctccagcggaaacatggcggtaatttagtaagatgtcctctgagccgcaactctacccacgagatgtactgggtgtccggggcatcaggaaatattgttagctcggtcaacacaacttctaagatgcttctgaataggtttaccacacgacaccggaaaccaacctatgaaaaggatgtggacctaggcgctggcactagaagtgtgtccacggagacagagaaacccgatatgaccatcatcgggaggcgcctccagcgtctgcaggaagagcataaggaaacttggcactacgaccaagagaacccgtaccggacctgggcctatcatggaagctacgaagccccttcaacaggttccgcgtctagcatggtcaatggcgttgtgaaattgctgacgaagccatgggatgtaattcccatggtgacccagctcgctatgactgacacaacccctttcgggcagcagagagtctttaaggagaaagtggacactaggacaccacaacccaagccgggaacccgcatggttatgacaactaccgcaaactggctttgggccctgttaggcaaaaagaaaaatcctcgactgtgcacgaaggaggaattcataagtaaggtgcgggctaacgccgcaatcggtgccgtctttcaggaggaacaggggtggacctccgctagcgaggcggtgaacgattctagattctgggaattggtagacaaagagagggccctccaccaagagggaaagtgtgaatcatgcgtttataatatgatgggcaaacgcgagaagaaactgggcgaatttgggagagcaaagggaagtcgggctatttggtacatgtggctaggtgccaggttccttgagttcgaagcactgggctttctcaacgaggatcactggttcgggcgtgagaattcctggagcggagtggaaggcgagggtctgcatcgattggggtatatcctggaagagattgacaagaaagatggagacctcatgtacgccgatgacacagctggctgggatactcgcatcaccgaggacgatcttcagaacgaagagctgataacagaacagatggccccccaccataagatcttagcgaaagcaatttttaagctgacttatcagaataaagtcgtgaaggtgttgagaccaacccctcggggcgccgtcatggacatcatttctaggaaggatcaacgcgggtcgggacaggttggtacgtacggcctcaacacattcaccaatatggaggtgcagctgatcagacagatggaagctgagggggtaataactcaagacgacatgcagaaccccaaaggactaaaggagcgggtggaaaaatggcttagggagtgcggcgtcgatcgactgaagcgtatggccatttcaggtgacgattgtgtggttaaaccactcgacgaaagatttgcaacaagcctgttgttcttaaatgatatggggaaggtgcgcaaagacatcccccagtgggagccttccaagggatggaagaactggcaggaagtcccattttgcagtcaccatttccacaaaatctttatgaaggatggccggtctctggtggtaccgtgtaggaatcaagacgagctcattggcagagctcgcataagccagggggccggatggtcccttaaagagaccgcttgcctggccaaggcatacgcgcagatgtggtcactaatgtatttccaccggagggatctgcgactcgccagtatggctatctgttctgccgttcccactgaatggtttcctaccagcagaacaacgtggtccattcatgcacaccatcagtggatgaccactgaggacatgttgaaagtgtggaaccgggtctggatcgaagataatccaaacatgattgacaagacacccgtgcactcatgggaggacatcccttacctgggtaagagggaagatctttggtgcggcagcctgatagggctctcttcccgcgctacctgggccaaaaatatccacactgcaattacacaagttcgtaacttaatcggaaaggaggagtatatggactacatgccagtgatgagacgatatagtgcccccagcgaatcggagggcgtcctgtga

SEQ ID NO: 15799 - RNA, 9867 nt, synthetic construct
  misc_feature 1..9867: note = derived and/or modified CDS sequence (opt3) from DENV-4__KU523872__SS-prME
  source 1..9867: mol_type = other RNA
agcaccatgacgctgctctgccttatccccactgtgatggccttccacctgtccacgagagacggcgagcctttgatgattgtcgctaagcatgaaagggggcggccattactgtttaagaccaccgagggaataaacaagtgtactctaatcgcaatggatctcggtgaaatgtgcgaggacaccgttacatacaagtgtccgctgcttgtgaataccgaacccgaggatattgactgctggtgtaacctgacttctacatgggtaatgtatggaacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggatcctgcgcaatccagggttcgcactgctcgccggatttatggctcacatgattggccagactggcatccagagaaccgtgttctttgttttaatgatgctggtggcaccctcatacgggatgaggtgtgtcggagtgggtaaccgggatttcgtagaaggcgttagcgggggagcctgggtggaccttgtcttggagcatggcggttgcgtgacaaccatggctcaggggaagcctacgctggattttgaacttactaagacaaccgccaaagaggtggcgctcctgcgcacttattgtatagaagcaagtatctccaatattacaaccgccacgcgatgcccaacccaaggagagccctaccttaaggaggaacaggaccagcagtatatctgtagaagggatgtcgttgaccggggctggggcaacgggtgcggactgttcggtaaaggcggggtggtaacatgcgctaagttttcttgtagcggaaaaattactggcaatttggtgcaaatcgagaacctcgaatacaccgtcgtggttacagtgcacaatggtgatactcacgccgtcgggaacgacacctccaatcatggcgtgacagcaaccataactcctcgttcaccaagtgtagaggttaagctgccggattatggagaattaacgctggactgcgagccccgcagcggcattgacttcaacgagatgatcctcatgaagatgaaaaagaaaacatggcttgtgcacaagcagtggtttctggatttgcctctaccatggaccgctggggccgacacttctgaagtccattggaattacaaagagagaatggtgaccttcaaggtcccccacgcgaaaaggcaggatgtgacagttctgggatcccaggaaggtgccatgcactcagcactcgctggcgccaccgaggtggacagcggggatggaaaccatatgtttgctggccacctgaagtgtaaggtacggatggaaaaacttcgaattaagggtatgagttacactatgtgctctgggaaattctccatcgacaaggagatggccgagacacaacatggcacgaccgtcgtgaaagttaagtatgaaggagcaggcgccccttgtaaggtgccaatcgagattcgcgatgtcaataaagaaaaggtggtagggagaataatcagctcgactcccttcgctgagaacacaaactctgtgaccaatattgagctggaaccgccttttggagactcctacatcgttataggtgtcggcgattcagcgttgacactccactggttcaggaaagggagtagcattggaaagatgtttgagtccacttatcggggcgcaaaacgcatggccatcctgggtgaaaccgcttgggacttcgggtctgtgggcggattatttacgagcctgggcaaggccgtgcatcaggtcttcgggtcagtttacaccacaatgtttggaggcgtgagttggatgatcaggattctgatcggtttcctcgtgctgtggattgggactaactccaggaataccagcatggcaatgacatgcatagccgtaggaggcatcactctatttttgggtttcaccgtccaggctgatatgggctgtgtggtttcttggaacgggaaggagctgaaatgcggaaatggcatttttgtggtcgacaacgtgcacacgtggacagaacaatataagttccagcccgagtcaccagcccgtctcgcaagtgcgatcctgaatgctcacaaagacggggtttgtggaatccggagcaccactcgacttgagaacgtgatgtggaagcagattacaaatgaactgaactacgtattgtgggagggcggtcatgatctcaccgtcgtggccggggacgtgaaaggagtcctgactaagggcaagagagcattaacccctcccgttaatgatctgaaatattcctggaagacatggggtaaagccaagatatttacgccagaagctaggaactctaccttcctaatcgacggccccgatacttcggagtgccctaatgaacgccgggcctggaacttctttgaggtggaggactacgggttcggaatgtttacaaccaatatttggatgaaattcagagaaggcagctccgaggtatgtgatcacaggctcatgtcagcagctatcaaggaccagaaagccgtgcatgcggatatggggtactggattgaaagttctaagaaccaaacatggcagatcgagaaggccagcctgatagaagtcaaaacttgcctttggccaaagacccacacgttgtggtccaacggagtgctggagtcacagatgctcatcccgcgcagctatgctggccccttttctcagcacaattaccgacaaggttatgcaacacagaccgccgggccttggcatctgggaaaattagagattgacttcggcgaatgcccaggtactaccgttacaatccaggaggattgtgaccaccggggcccctccctgcgtactaccacagctagtgggaaacttgtgacgcagtggtgctgtagaagctgcaccatgcctccattgaggtttctcggagaagatggctgttggtacgggatggagattcgccccctgtctgagaaagaagagaacatggtcaagtcccaagtgactgccggacagggcacatcagaaaccttcagtatgggtctactgtgcctcactctgtttgttgaggaatgtcttcggagaagggtgacacgaaagcatatgatcttggtcgtagtgataaccttctgcgcaattatcctagggggcttaacgtgggttgacctcctgcgcgcgcttattatgctgggcgacactatgagcggccggatcgggggacagatacacttggccatcatggctgtgtttaaaatgtcgccgggttatgtcctcggcgtgttcctgagaaagctaacctccagggagacagccctgatggtaattgggatggcaatgaccactgtgttttctatccctcatgatctcatggagctgattgacggaatcagccttggcttgatactgttaaaaattgtcacacacttcgataatacccaggttggtacactcgctctgtcacttactttcatccgtagtaccacgccactggtgatggcctggcgcacaatcatggcagtgtttttcgtcgtgaccctaattcccctctgtcggacttcctgcctgcaaaagcagtctcactgggttgaaatcaccgccttgattctgggggctcaggcgttacctgtatacctcatgacactgatgaaaggagccagcagaaggtcctggccccttaacgagggcataatggcagtgggcctggtctcattgctcgggagcgctctgctaaagaatgacgtgccactggccggacctatggttgccggtggccttctcctggctgcatatgtgatgagtgggtcttccgccgatttgagcctggaaaaggcggctaacgtccaatgggacgagatggccgatatcactggatcgtcacccgtgattgaagtaaaacaggacgaggatggctcttttagtatccgagacgtcgaggaaaccaatatgattacgttactcgtgaagctggcacttatcacagtttccggtctgtacccattggccataccggtgaccatggctatctggtacatttggcaggtcaaaactcagcggagcggggcactctgggatgtgccttctcccgccgcgacacaaaaggctaccctgagcgagggagtttatcgcatcatgcagagaggcctattcggcaaaactcaggtgggggtcgggattcacatggaaggtgtgtttcacacaatgtggcatgtaaccaggggctccgtgatctgtcacgagacggggcggctggaaccatcatgggccgacgttcgaaacgatatgataagttacggaggcggttggaaacttggggacaagtgggacaaagaggaggatgtccaggtgctcgcaattgaacccggaaagaatcctaaacatgtgcaaactaagccaggcctgttcaaaaccttgacaggcgagatcggggccgtcaccttagactttaagcccggaacaagcggttctcctatcattaacaaaaagggcaaggtaatagggctgtatggaaatggcgtggttactaaatccggtgattacgtgtcagctatcacccaggccgaaagaattggggagccggactatgaggtcgatgaagacatcttccgcaagaaaaggctcacgattatggatctgcacccaggagcaggcaagacaaaacgtatccttcccagtatagtgcgggaggctctgaagagaaggttgcgcactctaatcctggcccctacccgagttgtggcggccgaaatggaggaagcactcagaggcctgccaattcggtaccagacacccgctgtcaagagcgagcacaccgggagggagatcgtggaccttatgtgccatgccacttttaccacacgcttactgtcctctacgcgtgtacctaactataatctcattgtgatggatgaagctcacttcactgacccgtgctcggttgcagccagaggatacatcagcacccgggtcgagatgggtgaagccgctgcgatatttatgacagcaacacccccaggctcaattgatcctttcccccagtccaacagtccaatcgaggacatcgaaagggagattcctgagcgctcttggaatactgggttcgactggatcacagattaccaaggaaaaaccgtgtggtttgtgcccagcataaaggccggcaacgacattgctaactgtttgcgaaaatccggtaagagagtcatccagctgtcacggaaaacgttcgatactgaatatccaaagacaaagctcaccgactgggattttgttgtgaccactgacatttctgagatgggggccaatttcagggcaggccgcgtaatcgatccgagaaggtgcctgaaacctgtgatacttacagacggacccgaacgggtcattctggccggcccaatccccgtgacccctgctagcgcggcccagcgtcgcgggcgaatcggaagaaacccagcacaagaggatgaccagtacgtttttagtggtgatcccttgaggaatgacgaagatcatgctcactggacagaggccaagatgctactggacaacatttatactcctgagggcatcattccgacactcttcgggccagaacgggagaaaacccaggcaatagacggagaatttcgcttaagaggcgagcagaggaagacattcgtggagctgatgcggcgaggtgatcttcccgtctggctgtcctacaaagtagccagcgctgggatctcttataaggacagagaatggtgttttactggcgagcgcaataaccaaattctcgaagagaatatggaagtggagatctggaccagggagggagaaaagaaaaagttgcggcctaaatggctggatgcccgtgtttacgcggaccccatggcactcaaggatttcaaagagtttgcctcaggcagaaagtccatcacactggacattcttaccgaaatagctactctaccaacgtatctgagtagcaaggccaaattggctttagataacatcgtgatgctgcacaccacagagaaagggggaagggcataccagcatgccctcaatgaactgcctgagtcgcttgagactctgatgctcgtcgctttgctgggtgccatgaccgcaggcattttcctatttttcatgcaggggaaaggaatcggcaagctgtctatgggtctcattgcgatcgccgtggcttccgggcttctgtgggtcgccgaaatacagccccaatggatcgcagctagcattatcttagagttctttttgatggtgctgctcattccagaacctgagaaacagcgcacaccgcaggacaaccagctgatctacgttatacttaccattctgactatcattggcctcgtggccgcaaatgaaatgggattgatcgagaagacaaaaacggatttcggcttttatcaagtaaagaccgagactacaatactggacgtggatttacggcccgcctcagcttggaccctatacgcggtcgccaccacaatcctgactccaatgctccgacacacgattgaaaacaccagtgcaaatctttctctggctgccatcgccaaccaggcagctgttttgatggggctgggaaagggctggcctctccatagaatggacctgggtgtgccccttctcgccattgggtgctattcccaggtcaatccaacaactctgaccgcgagcttggtgatgctgttagtacactacgctatcataggacctggcctacaggccaaagcaacaagggaggcccaaaagcgcaccgctgcaggtattatgaaaaaccccactgtggatggcatcacggttatcgacctggaaccgatttcatatgacccaaagttcgagaaacagctcggacaggtgatgcttctggtcttgtgtgtgggacaactgctcctgatgcggacaacctgggccctttgcgaggtcttaactctggcgaccggccctatcatgacactctgggaagggaaccccggaagattttggaatactaccatagctgtgagtacagccaacattttccgtggcagctacttggccggtgcagggctggctttttccctaatcaagaatgcccagacgccaaggcggggaaccggcactacaggtgagaccctgggcgaaaagtggaaacgccagctcaactctcttgatcgaaaggagttcgaagagtataaaagaagcgggattctggaggttgacaggactgaagcaaagtccgctttgcgggatggatcaaaaacaaagcatgccgtatctcgcggcagttcgaagatcagatggatagtggagagggggatgatcaaacccaagggaaaagtcgtggacctgggctgtggtcgagggggatggagctactacatggcgaccctcaagaatgttacggaagtgaaaggctataccaagggcgggcctggacacgaggaaccgattcccatggccacatacggttggaacctggtcaagttacactccggcgtggatgtattttataaaccaactgaacaggtggacacccttctgtgcgatatcggggagtcttcaagcaatcctacaattgaagagggaaagactctccgggttctaaaaatggtcgaaccctggctgtccagtaagcctgagttctgtatcaaagtgttgaacccatacatgcccaccgtgattgaagaactggagaagctccaacgtagacatggcggttctcttgtccgctgccctctgagcagaaattcaacacacgaaatgtattgggtttccggggcaagtggaaacatcgtgagctctgtaaataccatatccaaaatgttgctgaaccggtttactacgagataccgcaagccaacatatgagaaggacgtggatctcggcgctggcaccaggtcagtcagcactgaaaccgagaaacccgacatgacaattatcgggcgacggttacagagactgagggaggaacataaggagacgtggcactacgatcaggaaaatccgtaccgcacctgggcctatcacggatcgtacgaggcaccttctactggtagtgcttccagcatggtgaacggcgttgtgaaacttctgacaaagccatgggacgtcgtgcccatggtaacccagctagccatgactgacacaacccctttcgggcaacagcgtgtttttaaagaaaaggtggatacacggactccacagcccaagccgggaaccagaaaaatcatgacgaccacagccaattggctctgggcgctgttgggcaagaaaaagtcacctaggctgtgtactcgcgaggagttcatttccaaagtccgatctaacgctgcaataggtgccgtgttccaggaggaacaagggtggaccagcgctagtgaagccgtgaatgactcccggttttgggagctcgtcgataaggaaagagcacttcatcaggagggaaggtgcgagagctgcgtttataacatgatgggcaagcgcgagaagaagctgggcgagttcgggagagccaaaggatctcgggctatctggtacatgtggttaggtgcgaggtttctggagttcgaggccttgggctttctcaacgaagaccactggttctcacgtgagaatagttggtccggggtggagggagaaggcctgcatcgactaggttatattcttgaggatatcgacaagaaagatggggacctgatttacgcagatgacacagctggatgggatactcgcatcaccgaagacgatctcctgaacgaggagttgataacggaacagatggcaccccatcataagacactggccaaggccatctttaaactcacctatcaaaataaggtagtgaaagtccttagaccaactcctaagggcgctgtgatggacattatcagccggaaagaccagaggggctctgggcaggttggaacatacggtctgaacaccttcactaatatggaggtgcagttaattcgccaaatggaagccgagggcgtcatcacccaggatgacatgcagaaccccgaagggctgaaggagagagtggagaaatggttgaaggaatgtggagtagatcggctcaagaggatggcgatatcgggcgacgattgcgttgtgaaaccactggacgagcgattttcaacaagcctacttttcctgaatgatatgggtaaggtccgtaaagacattccccagtgggaaccttccaaggggtggaaaaactggcaagaggtgccattttgtagtcaccacttccataagatctttatgaaggatggaagatctctcgttgtgccgtgccgcaatcaggacgaactgatcggccgggcaaggattagccagggcgccgggtggtccttgagagagacggcttgtttaggaaaagcctacgcacagatgtggtcactgatgtatttccaccgccgggatctcaggcttgctagtatggccatatgctctgctgtccccaccgagtggttccctactagccgaacaacctggtccatccatgcccaccaccaatggatgactacagaagacatgctgaaggtgtggaacagagtatggattgaggacaatccaaacatgaccgataaaacgcccgtgcattcatgggaagacatcccttacctaggtaagcgggaggatctgtggtgtggcagcctcattgggttgtcttccagggcaacatgggcgaaaaatatccacaccgccataactcaggtccgcaacctgatcggaaaggaagagtatgttgactacatgccagctatgaagcgttatagtgccccctttgagagcgaaggcgtgctttga

SEQ ID NO: 15800 - RNA, 9867 nt, synthetic construct
  misc_feature 1..9867: note = derived and/or modified CDS sequence (opt3) from DENV-4__KP140942__SS-prME
  source 1..9867: mol_type = other RNA
agcaccatcacactgctctgccttattcccactgtgatggcattccacctgtccacgagagacggcgagcctttgatgatagtcgctaagcatgaaagggggcggccattactgtttaagaccacagagggaatcaacaagtgtactctgattgcaatggatctcggtgaaatgtgcgaggacaccgttacatacaaatgtccgctgcttgtgaataccgaacccgaggatatcgactgctggtgtaacctgacttctacatgggtaatgtatggaacctgcacgcaatcaggggagcgccgacgtgaaaagcggagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggcgccctacgctggattttgaactaactaagacaaccgccaaggaggtggcgctcctgcgaacttactgtatcgaagcaagtatttccaatatcacaaccgccacgagatgcccaacccaaggagagccctatcttaaagaggaacaggaccagcagtacatttgtaggcgggatgtcgttgaccgtggctggggcaacgggtgcggactgttcggtaagggcggggtggtaacatgcgctaaattttcttgtagcggaaagatcactggcaatttggtgcaaatagagaacctcgaatataccgtcgtggttacagtgcataatggtgatactcacgccgtcgggaacgacacctccaatcacggcgtgacagcaaccattactcctcgctcaccaagtgtagaggttgaactgccggattacggagagttaacgctggactgcgagcccagaagcggcatcgacttcaacgaaatgattctcatgaaaatgaataagaagacatggcttgtgcataaacagtggtttctggatttgcctctaccatggaccgctggggccgacacttctgaggtccactggaacaataaggaaaggatggtgaccttcaaagtcccccatgcgaagcggcaggatgtgacagttctgggatcccaggagggtgccatgcactcagcactcgctggcgccaccgaagtggacagcggggatggaaaccacatgtttgctggccatctgaaatgtaaggtacgaatggagaaacttcgcatcaagggtatgagttacactatgtgctctgggaagttctccatcgacaaagagatggccgaaacacaacacggcacgaccgtcgtgaaggttaaatatgagggagcaggcgccccttgtaaggtgccaattgaaataagagatgtcaacaaagagaaggtgatcgggagggtaattagctcgatccccctggctgagaatactaactctgtgacaaatatagaattggagccgcctttcggagactcctacattgttatcggtgtcggcaactcagcgctcaccctgcattggtttcggaaggggagtagcatcggaaaaatgttcgaatccacatatcgcggcgcaaagagaatggccattttaggtgagactgcttgggattttgggtctgtgggcggactgttcaccagcctaggcaaagccgtgcaccaggtctttgggtcagtttacacgaccatgttcggaggcgtgagttggatgatcaggattctcataggttttctggtgctttggatcgggacaaattcccgtaacactagcatggcaatgacctgcattgccgtaggaggcatcacattgttcctgggttttactgtccaggctgacatgggctgtgtggtttcttggtcagggcgggaactcaagtgcggaagtggcatcttcgtgattgataatgtccatacctggacggagcaatataaatttcagcccgagagcccagcccgactggcatccgcgatacttaacgctcacaaggacggggtgtgtggaatcagatctacaaccaggctggaaaatgttatgtggaagcagattactaacgagttgaattacgtgctctgggaaggcggtcacgacctgacagtagtcgccggggatgtgaaaggagtgttaaccaagggcaaacgcgcactgactcctcccgcctcggacctaaagtatagctggaaaacctggggtaaggctaagatcttcacaccagaggcccggaactccacgtttctcattgatggccccgacacctcagaatgccctaatgagagaagggcatggaacagtctggaggtcgaagattacgggttcggaatgttcactacaaatatctggatgaaatttcgcgagggctctagcgaaatgtgtgaccatcgacttatgtccgctgccataaaggatcagaaagcggttcacgccgacatggggtactggatcgagtcaagcaagaaccaaacctggcagattgaaaaggcttctttgatcgaggtgaagacatgcctgtggccaaaaactcataccctctggtccaacggagtactggagagtcagatgttaattccgaaaagctatgcaggccccttctctcagcacaattaccggcaaggttatgccacgcagatcgctgggccttggcacctgggaaaacttgaaatagattttggcgagtgcccaggtacaaccgtgactattcaggaagactgtgatcatcgtggcccctccttgagaaccacaactgcctcagggaaactcgtcacccagtggtgctgtaggagttgcacaatgcctccactgcgcttcctaggagaggacggctgttggtacgggatggagatccggcccctgagcgaaaaggaggaaaacatggtgaaatcgcaagttgcagcgggacagggcacgtccgagaccttttctatgggtctcctgtgccttactttgttcgtggaagagtgtctgagaaggcgagtcacacgcaagcacatgattttagccgtggttatcaccctctgcgctataatcctaggcgggcttacttggatggatctgttgcgggccctcattatgctgggggacacaatgagcggcagaatgggaggccagacccatctagcaatcatggctgtgtttaaaatgtcaccgggttatgtcctgggcgtattcctcaggaagctgacgagtcgtgagactgcccttatggtgattgggatggcaatgaccacaaccttgtccatccctcacgacctgatggaattaatagatggaatttctctcggcctgatccttctgaagatcgttactcagtttgacaatacacaagtgggtaccctagccctcagcctgacattcattcgctccactatgtcattggtcatggcttggcggaccatcatggcggtgctgtttgtagtgacgttaattccactctgtagaacaagctgcctgcagaaacagagtcattgggtcgagataaccgcccttatcctgggggcacaggctttgcccgtttacctcatgactctgatgaagggagcctctaaaaggtcctggcctctaaacgaaggcattatggccgtgggcctggtgagccttctcgggtcggctctgttgaagaatgatgtccccctggcaggaccaatggtggccggtggcttactcctggcggcttatgttatgtcagggtctagtgccgacctttccctggagaaagcagccaacgtacagtgggatgaaatggctgacatcaccggaagctctcctattatcgaggtgaagcaggatgaggacggcagcttctccatacgagatgtcgaagagacaaatatgatcactttgctcgtgaagctggcactaattaccgtttcaggtctgtacccccttgccatcccagtgacgatgacactctggtacatgtggcaggtcaaaacccaacggagtggggcgctgtgggacgtgccgagccctgctgccactcagaaggcagccttgtctgaaggagtatatcgcattatgcagagaggcttatttggcaaaacacaggtcggggtgggaatccacatggagggtgttttccacaccatgtggcatgtgactaggggctccgtcatatgtcacgaaacagggcggctggagccctcatgggctgatgtgcgaaacgacatgattagttacggaggcggttggagactcggggataagtgggacaaagaggaagacgttcaagtgctggccatcgagccaggaaagaatcccaagcatgtccagaccaaacctggccttttcaagacgctgactggcgaaatcggggcagtgaccttggattttaaaccaggaacaagcggttcccccattataaaccgcaagggcaaagtaatcgggctatatggaaatggcgtggttaccaagtctggtgactacgtctcggctattacacaggccgagaggatcggggagcctgattatgaagtggacgaggatattttccgtaaaaagcggctgactatcatggacctccacccgggagcgggcaagaccaaaagaatactgccaagcatcgtgagggaagcccttaagcgccgattaagaacgctgattctcgcacccacacgggtcgtagctgccgagatggaagaggctttgaggggcctgcctatccgctaccagactccagcagtgaaatcagagcataccgggcgtgaaattgttgatctcatgtgccacgccacatttaccactagactgctttccagtacccgggtgcccaactataatctgatcgtcatggacgaggcccacttcacagatccttctagcgtggctgcgaggggatacatatccacgcgcgttgaaatgggtgaggcagccgctatttttatgactgccaccccgcccggcgcaacagacccattccctcaatcaaactctcccatcgaagatatcgagcgagagattccagaaagaagctggaataccgggtttgactggatcactgactaccagggaaagacagtgtggttcgtccctagtataaaagccggcaacgatattgctaactgcttgcggaagtccggtaagaaagtgatccagctaagcaggaagacctttgacacggagtatcccaaaactaagctgacagattgggacttcgtagtgaccaccgatatttctgaaatgggggcgaattttcgcgccggcagagttatcgacccaaggcggtgtctcaaaccggtcatattaactgatggacctgagcgtgtgattctggcaggccccatcccagtgacacccgcttcagccgcacaacgccgagggagaatcggaaggaaccctgcccaggaagacgatcagtacgtcttctccggtgacccacttaagaatgatgaggaccatgctcactggaccgaggccaagatgctgctcgataacatttatacacccgaaggcatcattcctactttgttcgggccggagcgggagaagacgcaggcgatagacggagagtttcgcctgagaggcgagcaaaggaagaccttcgttgaactcatgcggcgaggtgacctgccagtgtggcttagttacaaagtagcaagcgccgggatctcgtataaggatagagagtggtgctttacaggcgaacgcaataaccagattctagaggaaaatatggaggtggagatctggactagggaaggagagaaaaagaagctgcggccccgttggttggacgctagagtctacgccgatcctatggctttaaaagacttcaaggaatttgcatctggcaggaaatccctgaccctcgatatcctgacagagattgccagccttcccacctatctgtcaagtcgcgctaagctcgccttggacaacatagtgatgctgcatactacggaaagagggggacgagcataccagcacgcgctaaatgagctgccagagtctctcgaaacccttatgctggttgccttattgggtgctatgacagccggcatcttcctgtttttcatgcaggggaaaggaattggcaagctctccatgggtctgatcactattgcagtggctagcgggcttctgtgggtcgccgagatccaacctcagtggatagcagcctcaatcattctcgaatttttcttgatggtactgttaatccccgagccagaaaagcagagaacccctcaggataaccaactaatttacgtgatcctgacaatactcaccattatcggccttattgctgcgaatgagatgggactgatcgagaaaactaagacagactttggcttctatcaggttaaaacggaaaccactatattggatgtggacctgaggccggccagtgcatggacactctacgctgtcgccaccaccatcctgacacccatgcttcgccacactattgagaacacgagcgccaatctctccctggcagctatcgccaaccaggcggctgtgttgatggggctgggaaagggctggccattacatcggatggatctaggtgtccctctgctcgccatggggtgttattctcaggtgaatcccaccacacttactgcaagcctggttatgttgctggtgcactacgccattatcggaccaggcctccaagctaaagcaaccagagaagcccagaagcgtacagcggctggtataatgaaaaaccctaccgtagacggcattactgtgatcgatctggagcccatctcctatgacccgaagtttgagaagcagcttgggcaagtcatgttactggttctctgcgccggacagttgctgctaatgaggacgacatgggcattctgtgaagtgctgaccctcgccactggcccaattcttaccctgtgggaggggaaccctggacggttctggaatacaactatcgctgtctcaaccgccaacatatttcgcggctcttacttggccggtgctgggctggccttcagtctcattaaaaatgcgcagacaccccgaagaggaacgggcaccactggtgaaacactgggcgagaagtggaaaaggcagttaaactcgcttgaccggaaggaatttgaggagtataaacgcagcgggatcctggaagtggatagaaccgaggccaagtccgcactcaaggacggatctaaaattaagcatgctgtatcaaggggcagctccaaaatccgatggatagtggaacgggggatggttaagccaaaaggaaaggtggtcgatctaggctgcggtcgtgggggatggagttactacatggccactctgaagaatgtgacagaggtcaaaggctataccaagggcgggcccggacacgaagaacctatcccgatggcaacgtacggttggaacttggtgaaactgcattctggcgttgacgtattctataagcccaccgagcaagtggatacactcctttgtgacattggggaaagctcatccaatccaactatcgaggaaggaagaaccctgcgcgtcttgaaaatggtggagccttggctgagtagcaagcccgaattttgcattaaggttctcaacccttacatgccaacagtgatcgaggagttagaaaaactgcagaggaagcacggcggtaatcttgtccggtgtcccctgtctagaaactccactcacgagatgtattgggtgtcaggggctagcggaaatattgtatcgtctgtgaacaccacaagtaaaatgctactcaatcgcttcaccactaggcatcgaaagcctacgtacgaaaaagatgttgacctgggcgccggcacacggtccgtcagcaccgagactgagaagccagatatgaccatcatagggagaaggttgcagcgcctgcaggaagaacacaaagaaacatggcattatgaccaagagaacccctaccgtacgtgggcctaccacggatcatatgaagcgccgtccaccggttctgctagcagtatggtgaatggcgtggtcaagctccttactaagccttgggatgttattccaatggtgacacagctggcaatgaccgacactacaccctttgggcagcagcgggtattcaaagagaaggtggacaccagaacacctcaaccaaaacccggaactaggatggtcatgaccacgaccgccaactggttatgggctctgttgggcaagaaaaagaatccgcgcctctgcacaaaggaggaatttatctccaaagtgcgagccaacgcagccatcggtgctgttttccaggaggaacaggggtggactagcgcgtctgaggccgtgaacgattcacggttttgggaactggtcgacaaggagagagcactacaccaagagggaaaatgtgaaagttgcgtgtacaatatgatgggcaagagggagaagaaacttggcgagttcgggcgcgctaaaggatccagagccatttggtatatgtggctgggtgcacggtttctcgagttcgaagccctgggcttcttgaacgaggatcattggtttgggagggagaatagctggtctggagtagaaggcgagggtctgcaccgtctcgggtacatacttgaagagatcgacaaaaaggatggagacctgatgtatgctgatgacaccgccggctgggatacacgaattactgaggacgatttacagaacgaggaactgatcaccgaacagatggcgcctcatcacaaaattttggcaaaggccatcttcaaactcacgtaccagaataaggttgtgaaggtcctgcgccccacaccaagaggcgctgtgatggacataatctcgcggaaagatcaaagggggtcaggacaggtgggtacctatggcctaaacacttttacaaatatggaggtccagcttattcgccagatggaagccgagggggttatcacccaagacgacatgcagaaccctaagggactgaaagagagagtggaaaagtggctccgggagtgcggcgtagataggctgaaacgaatggcaattagcggtgacgattgtgtggtcaagcccttggacgaacgtttcgctacttccttactgtttctcaatgatatggggaaagtgagaaaggacatcccacagtgggagcccagtaagggatggaaaaactggcaggaagttcctttctgctctcatcactttcacaagatattcatgaaagatggccgcagccttgtggtcccatgtcggaatcaagacgagctgattggcagggccagaatctcccagggggctggatggtcactaaaggagaccgcctgcctggcaaaagcgtacgcccagatgtggagtctcatgtactttcatcgccgggatttgaggctggcttctatggccatctgtagcgcagtgccgacagaatggttccccacgtcccgaaccacttggtcaattcacgctcatcaccagtggatgacaaccgaggacatgcttaaggtatggaacagagtttggatagaagataatcctaacatgatcgacaagactccagtgcacagctgggaggacattccctatctgggtaaacgggaagatctctggtgcggctctttaatcgggctgtccagtagggccacatgggcaaagaatattcataccgccatcacgcaagtccgcaacttgataggaaaagaggagtacatggactatatgcctgtgatgcgtagatacagcgcgccatcggaatccgagggcgttctgtga

SEQ ID NO: 15801 - RNA, 9867 nt, synthetic construct
  misc_feature 1..9867: note = derived and/or modified CDS sequence (opt3) from DENV-4__KU523871__SS-prME
  source 1..9867: mol_type = other RNA
agcaccatgacactgctctgccttatccccactgtgatggccttccacctgtccacgagggacggcgaacctttgatgattgtcgctaagcatgaaagggggcggccattactgtttaaaaccacagaaggaataaacaagtgtactcttatcgcaatggatctcggtgaaatgtgcgaagacaccgttacatacaaatgtccgctgcttgtgaataccgaacccgaggatattgactgctggtgtaacctgacttctacatgggtaatgtatggaacctgcacgcagaatggggagcgccgacgtgaaaagagatcagtggccttgactcctcacagtggaatgggcctcgagaccagggcggaaacatggatgagctccgagggtgcttggaaacatgcccagcgggtcgagtcttggatcctgcgcaacccagggttcgcactgctcgccggatttatggcttacatgattggccagactggcatccagagaatagtgttctttgttttaatgatgctggtggcaccctcgtatgggatgaggtgtgtcggagtgggtaatcgggatttcgtagaaggcgtttcagggggagcctgggtggaccttgtcttggagcacggcggttgcgtgaccacaatggctcaggggaagcctaccctggattttgaactaacgaagactacagccaaagaggtggcgctcctgcgcacctactgtatcgaagcaagcattagtaacatcactacagccacccgatgcccaacgcaaggagagccctatcttaaggaggaacaggaccagcagtacatttgtagaagggatgtcgttgaccggggctggggcaatgggtgcggactgttcggtaaaggcggggtggtaacctgcgctaagttttcctgttctggaaaaatcacaggcaacttggtgcaaatagagaatctcgaatatactgtcgtggttaccgtgcataacggtgatacacacgccgtcgggaatgacactagcaaccacggcgtgaccgcaacaattacccctcgttccccatcagtagaggttaagctgccggattacggagaattaactctggactgcgagccccgcagtggcatcgacttcaatgagatgattctcatgaagatgaaaaagaaaacgtggcttgtgcataagcagtggtttctggatttgcctctaccatggacagctggggccgacaccagcgaagtccactggaaccataaagagagaatggtgactttcaaggtcccccacgcgaaaaggcaggatgtgaccgttctgggatctcaggaaggtgccatgcactccgcactcgctggcgccacagaggtggactcaggggatggaaatcatatgtttgctggccacctgaagtgtaaggtacggatggaaaaacttcgaatcaagggtatgagctacaccatgtgcagtgggaaattctctatcgacaaggagatggccgagactcaacatggcacaacggtcgtgaaagttaagtatgaaggagcaggcgccccttgtaaggtgccaattgagatacgcgatgtcaacaaagaaaaggtggtagggagaatcatttccagcacccccttcgctgagaacactaattcggtgacaaacatcgagctggaaccgccttttggagactcttacatagttattggtgtcggcgagtccgcgttgaccctccactggttcaggaaagggtcaagtatcggaaagatgtttgaaagcacatatcggggcgcaaaacgcatggccatcctgggtgagactgcttgggatttcgggtccgtgggcggattatttacctctctgggcaaggccgtgcatcaggtcttcgggagcgtttacacgaccatgtttggaggcgtgtcatggatggtgaggattctgatcggtttcctcgtactgtggattgggacaaatagtagaaacacttccatggcaatgacctgcatagccgtcggaggcatcacactatttttgggtttcactgtgcaggctgacatgggctgtgttgtgagctggtctgggaaggaactgaaatgcggatcaggcatttttgtcgtggataatgttcacacctggacggagcaatataagttccagcccgagagtccagcccgtctcgcaagcgcgatcctgaacgctcacaaagacggggtgtgtggaatccggtccacaacccgacttgaaaatgtaatgtggaagcagattactaacgagctgaattacgtcttgtgggaaggcggtcatgacctcacagtggtggccggggatgtcaaaggagttctgaccagaggcaagagggcattaactcctcccgtgaacgacctgaagtattcttggaaaacctggggtaaggccaaaatatttacaccagaggctcgcaattcgacgttcctaatcgatggccccgacaccagcgaatgccctaacgagcggagagcctggaatttctttgaggtagaagattacgggttcggaatgtttactacaaacatttggatgaagttcagggagggctcctcagaagtgtgtgaccaccgcctcatgagtgcagctatcaaagatcagaaggccgtccatgcggacatggggtactggattgagtctagcaaaaatcaaacctggcagatcgaaaaggcctccctgatagaggtgaagacatgcctttggccaaaaactcacaccttgtggtcaaacggagttctggagagccagatgctcatcccgcgatcttatgctggccccttttcccagcacaactaccggcaaggttatgcaacgcagacagtggggccttggcatctgggaaagttagaaattgatttcggcgagtgcccaggtaccactgtcgccatccgtgaagactgtgatcacagaggccccagtctgaggaccacaactgctagcgggaaacttgtgacccagtggtgctgtcgctcttgcacaatgcctccattgcggtttctcggagaggacggctgttggtacgggatggagattagacccctgtccgaaaaggaggaaaatatggttaaatcacaggccacggcaggacaaggcaccagtgagactttcagcatgggtctactgtgcctcacactgtttgtggaagagtgtcttaggcgacgcgtcacccggaagcatatgatcttggtagtggttataactttctgcgcgattatcctaggcgggttaacatggatggatctcctgagagcccttattatgctgggggacaccatgtcgggcaggatcgggggacagatacacttggctatcatggccgtgtttaagatgtccccgggttatgtcctcggcgtgttcctgcgtaaactaacgtctcgcgagactgcactgatggtaattgggatggctatgaccacagtgtttagcatccctcatgacctcatggaactgattgatggaatctcacttggcttgatactgttaaagattgtcacccacttcgacaacactcaggttggtacactcgccctgagtcttaccttcctgcggtccacaactcccctggtgatggcatggagaaccatcatggccgtgtttttcgtcgtgacgctcatccccctgtgtaggacatcttgcttgcagaaacaaagccactgggttgagattaccgctctgatcttaggggcgcaggccctccctgtatacctgatgactcttatgaagggagcatcccgacggtcatggcccctgaatgaaggcattatggctgtgggcttggtcagcctcctggggagtgccctactgaaaaacgatgtgccacttgccggacctatggttgctggtggcctcctgttggcagcctatgtgatgtctgggtccagcgcggacctgtcgttagagaaggctgccaatgtccagtgggatgaaatggcagacataaccggatcatctcccatcattgaggtgaagcaagatgaggacggcagtttttccatccgcgatgtagaagagacaaacatgatgactctcctggtcaaacttgccctgattaccgtgagcggtttgtacccactcgctatcccggttacgatggcactgtggtacatatggcaagtgaagacacagagatctggggccctatgggacgtccctagccccgcggctacccagaaagccactctgtccgaaggagtgtataggatcatgcaacggggccttttcggcaagacacaggttggggtgggcattcatatggagggtgtctttcacaccatgtggcatgtgactcgaggctcagtaatctgtcacgaaacagggagactcgagccaagttgggcagatgtgcgcaatgacatgattagctacggaggcggttggaggctgggggataaatgggacaaggaggaagacgttcaggtcttggccatcgagcccggaaagaaccctaaacatgtgcagaccaagccaggcttattcaaaacgctgactggcgaaataggggctgtgaccctcgattttaagcccggaacatctggttcccctattatcaataaaaagggcaaagtcatcgggctgtatggaaacggcgtagtgaccaagtcaggtgactacgttagtgccattacacaagcagagcgtataggggagccggattatgaagtggacgaggatatcttccggaagaaaagacttactattatggacctgcacccaggagctggcaagaccaaaaggatcttgcccagcattgtccgcgaagccctaaagcgaagactgcggacgctcatcctggcgcctacaagggtggttgccgcagagatggaagaggcacttcgcggcttaccaatacgttaccagactcccgccgtgaaatccgagcacaccgggagagaaatcgtcgatctgatgtgccatgctacatttaccactcggctcttgtcttcgaccagggtgcctaattataacctgattgtaatggacgaggcacacttcacagatccgtgcagcgtggccgcccgcggatacatctcaacgcgagttgaaatgggtgaggctgcggcaatttttatgactgccacaccaccaggcgctacagaccctttcccccagtccaatagtccaatcgaagatatagagagagagattcctgaacggtcttggaacaccgggttcgactggatcactgactaccagggaaagacagtctggtttgtgcccagcatcaaggccggcaatgatattgcaaactgtctcaggaaatccggtaagcgcgtgatccaactgtcaagaaaaaccttcgacacggagtatccaaagactaaacttacagattgggactttgtcgttaccaccgatatatctgaaatgggggccaacttcagggctggccgggtgattgacccgcgtcgctgcctgaagcctgtaatcttgactgatggacccgagcgagtgattctagcgggcccaatccccgtcacccctgccagcgcagctcagagaagggggcggataggacgcaatccagcccaggaagacgatcaatacgtgtttagtggtgaccccctgaagaacgatgaggaccatgcacactggaccgaggccaaaatgctcttagataatatttatacacctgaaggcatcatcccgactctgttcgggccagagagagaaaagacgcaggctattgacggagagtttaggcttcggggcgagcagcgaaaaaccttcgttgaactgatgaagagaggtgacctccccgtgtggttgtcctacaaagtcgccagcgcggggatctcttataaggatcgcgagtggtgttttacaggcgaaaggaacaatcagattctggaggaaaacatggaggtagagatatggactaaggaaggagagaaaaagaaactccggcctaagtggctggacgcacgtgtgtacgccgatcccatggctcttaaagacttcaaggaatttgcctcaggcagaaagtccatcaccctagatattctgacagagatcgctagtttgccaacctatttaagctcgaaagcaaagctggccctcgacaatatcattatgctgcacactacggaaaaagggggaagggcttaccaacatgcccttaacgagctgcctgagtctctcgaaaccttgatgctggttgcactactgggtgcgatgacagccggcatattcctctttttcatgcaggggaagggaatcggcaaactttccatgggtctgattgctatcgccgtggcaagcgggttattgtgggtcgctgagattcagccccagtggatcgccgcatcaataatcctggagttctttctcatggtgctgcttattccagagcctgaaaagcaacgcactccgcaggataatcagctgatctacgtcattctcaccatcttgacaataattggcctgatcgccgctaacgagatgggattaattgagaaaaccaagactgacttcggcttttatcaggtgaagacagaaacgaccatcctagatgttgacctgcggcccgcgagtgcctggactctctacgcagtggctacaaccatacttaccccaatgctgcgacacacaatcgagaatacttctgccaacttgtccctggccgcaattgctaatcaagccgcggtactcatggggctgggaaaaggctggcctcttcatagaatggatctcggtgtgcccctgttggctatcgggtgctatagccaggtcaacccaacgaccctgacagcctcattagttatgctactggtgcactacgcaattatcggacctggcctccaggccaaggctactagggaagcacagaaacgcaccgccgcgggtataatgaagaatcccacagtcgacggcattaccgtgatcgatcttgagccgatcagttatgacccaaaattcgagaagcaactggggcaggtaatgttgctggtgctctgtgctggacagctgcttttaatgcggactacgtgggccctgtgcgaagttctcacattggcaaccggccctgccatgactctgtgggaggggaaccccggaagattttggaacaccacaattgctgtgagcactgccaatatcttccgtggctcctacctagctggtgctgggctggccttttctctcataaagaacgcgcaaaccccaaggcggggaacaggcacgaccggtgaaactcttggcgagaaatggaagcgccagctgaatagcttggaccgaaaagagttcgaggagtataagagatccgggattctggaagtcgataggacagaggccaaatcagcactcaaggacggatctaagatcaaacatgctgtgagtcggggctcgagcaagattcgctggatcgtcgaaagagggatggtgaaacccaagggaaaagttgtagatctgggctgtggtagagggggatggtcctactacatggccaccttaaagaacgtgactgaggtcaagggctatacaaaaggcgggcctggacacgaagaaccgatacccatggcaacctacggttggaatcttgtgaagctgcactctggcgttgacgtgttttataaaccaacggagcaggtcgataccctcctatgcgacatcggggaatcaagctccaaccctacaattgaggaaggacgaactctgcgggtgttgaagatggtagagccctggctgagttctaaacctgagttctgtatcaaggtgctcaatccatacatgcccaccgttattgaggagcttgaaaaactgcagcgtagacatggcggtagcttggtccgctgccctctgtcaaggaactccacacacgagatgtattgggtgagtggggctagcggaaatatcgtgtcttccgtcaacactatttcaaagatgctcttaaatcggtttaccacaagacatcgcaagccaacctacgaaaaagatgttgacctgggcgccggcactaggagcgtgtcgacggagacagagaagcccgatatgaccatcatagggcgacggcttcaaagactgagggaagaacacaaagaaacttggcactatgaccaggagaacccgtaccgcacctgggcctaccatggatcttatgaagcgcctagtacaggttccgctagctcaatggtaaatggcgtggtcaagctactcacgaaaccatgggatgtggttcccatggtgacccagctggcaatgactgacacaacccctttcgggcagcaacgtgtctttaaggagaaggtggacactcggacaccacagcccaaaccgggaaccagaatgattatgacaactaccgccaactggttgtggacgctgctcggcaagaaaaagtcccctaggctttgtacccgcgaggagttcatctctaaagtacgaagcaatgctgccatcggtgcagttttccaggaggaacaggggtggacaagtgcctccgaggctgtgaacgatagccggttttgggaactggtcgacaaggagagagcgttacaccaagagggaaagtgcgaatcttgcgtgtacaatatgatgggcaaaagggagaagaaactgggcgagttcgggcgcgccaagggatcaagagcaatgtggtatatgtggttgggtgctcggtttctcgagttcgaagccctgggctttctaaacgaggatcattggttcagtagggagaactcctggagcggggtggaaggagagggccttcaccgtctgggttacattctcgaagacatagataaaaaggacggggatctgatctatgcagacgatactgccggatgggacacccgaattacagaggatgacttgctgaatgaggaactcatcactgagcagatggctccccatcacaagacccttgccaaagcgatttttaagctgacgtaccagaacaaagtcgttaaggtgttacgcccaacacctaaaggcgcagtaatggatatcatatctagaaaggaccaacggggctcgggacaggtgggaacctatggtctgaatactttcacaaacatggaagtccagttgatcaggcagatggaggccgaaggcgtgattacccaagacgatatgcagaatcccaaagggctcaaggagcgcgttgagaagtggctgactgaatgtggagtggacagactaaaacggatggctatctcaggcgatgactgcgtcgtgaagccacttgatgagaggtttagcacctccctactcttcctgaacgacatgggtaaagtacgaaaggatattccccagtgggaacctagtaaagggtggaagaattggcaggaggttccattttgttctcaccatttccacaagatctttatgaaagacggacgtagcttggtggtcccgtgcagaaaccaagatgaattaataggccgcgcccggatttcccagggcgcagggtggtcactgagggagacagcttgtctcggaaaggcctacgctcagatgtggagtcttatgtacttccatagacgcgacctgcggctagcctctatggcaatctgcagcgcggtgcccacggagtggttccctacctccaggactacatggtcaatccacgcccaccatcagtggatgaccactgaagatatgctgaaagtttggaatcgagtgtggattgaggacaacccaaatatgacagacaagacccccgtctatagctgggaagatataccttacctcggtaaaagagaggacttgtggtgtggctctctgatcgggctttccagtcgggctacgtgggccaagaacattcacacagcaatcacccaagtgaggaatctgattggaaaggaagattatgtagactacatgccaatcatgaaacgctatagcgctccctcggagtccgagggcgtgctctga

SEQ ID NO: 15802 - RNA, 9867 nt, synthetic construct
  misc_feature 1..9867: note = derived and/or modified CDS sequence (opt3) from DENV-4__HQ332175__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcacttattagtaatatcacaaccgccacgcgatgcccaacccaaggagagccctatctgaaggaggaacaggaccagcagtacatttgtagaagggatgtcgttgaccggggctggggcaacgggtgcggattgttcggtaaaggcggggtggtaacatgcgctaagttttcctgttctggaaaaatcactggcaatctcgtgcaaatagagaacctggaatataccgtcgtggttacagtgcataatggtgatactcacgccgtcgggaacgacaccagcaatcacggcgtgacagcaaccattactcctcgttccccatcagtagaggttaagttaccggattacggagaactgacgctcgactgcgagccccgcagtggcatcgacttcaacgagatgattcttatgaagatgaaaaagaaaacatggctggtgcataagcagtggtttttggatctacctctgccatggaccactggggctgacaccagcgaagtccactggaattacaaagagagaatggtgacattcaaggtcccccatgccaaaaggcaggatgtgaccgttctcggatctcaggaaggtgcgatgcactccgccctggcaggcgctactgaggtggactcaggggatggaaaccacatgtttgccggccatcttaagtgtaaggtacggatggaaaaactgcgaatcaagggtatgagctatacaatgtgcagtgggaaattctctatcgacaaggagatggctgagacgcaacacggcaccactgtcgtgaaagttaagtacgaaggagccggcgcaccttgtaaggtgccaattgagatacgcgatgtcaataaagaaaaggtggtagggagagtgatctccgccacacccttggctgagaacaccaacagcgttacaaatattgagctcgaaccgcctttcggagactcgtatatcgtcataggtgtgggcaactctgcgctgactttacattggtttaggaaagggtcctcaattggaaagatgttcgagagtacctaccggggcgcaaaacgcatggccatcctgggtgaaacggcttgggattttgggagcgtgggcggactattcacctccctcggcaaggccgtccaccaggtttttgggtctgtgtatacaactatgttcggaggcgtgagctggatgatcagaattctgatcggttttcttgtattgtggattgggaccaattcaaggaacacaagtatggcaatgacttgcatagccgtcggaggcatcaccctgttcctcggttttacggtgcaggctgacatgggctgtgttgtgtcctggagcgggcgtgagctgaagtgcggatctggcattttcgtcgtggataatgttcatacatggaccgaacaatacaaatttcagcccgagtcaccagcccggcttgcaagtgcgatcctgaacgctcacaaggacggggtgtgtggaatccgaagcactacaagattggagaatgtaatgtggaaacagattaccaacgaactcaattatgtcctgtgggagggcggtcacgacttaactgtggtggccggggatgtcaagggagttctgaccaaaggcaagagggcactaacacctcccgcctccgacctcaagtactcttggaaaacgtggggtaaggctaaaatattcaccccagaagcccgcaactcgacttttctgatcgatggccccgacacaagcgagtgccctaatgaacggagagcatggaactccttcgaggtggaggattacgggttcggaatgtttaccacaaatatttggatgaagttcagggaaggctcaagtgaggtatgtgaccatcgccttatgtctgctgccatcaaagatcagaaggcggtgcacgccgacatggggtattggattgaaagctccaaaaaccaaacttggcagatcgagcgagcttcattgatagaagtcaagacctgcctgtggccaaagacgcatacactctggagcaatggagtgctggagtctcagatgttaatcccgaaatcctacgcaggcccctttagtcagcacaactatcggcaaggttacgccacccagactgttgggccttggcacctgggaaagcttgagattgatttcggcgaatgcccaggtaccacagtgactatccaggagaactgtgaccatcgtggccccagcttgagaaccacaacggcttctgggaaactcgtcacccagtggtgctgtaggtcctgcactatgcctccactgcgctttctaggagaagatggctgttggtatgggatggagattcggcccctgtcagagaaggaagagaatatggtgaaaagtcaagttacagccggacagggcaccagcgaaactttctcgatgggtctcctgtgccttacattgtttgtggaggaatgtctgagaaggcgagtcacccgcaagcacatgatcttagcagtagtgataacgctctgcgcgattatcctggggggacttacttggatggacctgttgcgggccctcattatgctgggcgataccatgtccggcagaatcgggggacagacacatctagctataatggccgttttcaagatgtctccgggttacgtgctgggcgtctttctcaggaaactgaccagccgtgagactgcacttatggtgatcgggatggctatgacaaccacattgtcaattcctcacgacctgatggagttaatcgacggaattagtctcggcctgatccttctgaagatagtaactcagttcgataacacccaagtgggtacgctagccctctccctgacatttattcgctctaccatgagcttggtcatggcatggcggactatcatggccgttctgttcgtggtgaccttaatcccactctgtagaacatcctgcctgcagaaacagtcacattgggtcgaaattactgctcttatcctgggggcgcaagccttgcccgtgtatctcatgaccctgatgaagggagcaagcaggcgaagttggcctctaaatgagggcattatggctgttggcctggtatctcttctcgggtccgccctgttgaaaaacgacgtgcccctggccggaccaatggtcgctggtggcttactcctggcagcctacgtgatgagcgggtcgtcagttgatctttctctggaaaaggcggctaatgtgcagtgggacgagatggccgatataacgggaagttcccctatcattgaagtcaagcaggacgaggatggcagcttttctatccgggacgtggaggaaacaaacatgattaccttgctcgtaaaactggcactaatcactgtcagcggtctgtacccccttgccataccaatcacaatgaccctctggtatatgtggcaggtgaagactcaacgctccggggctctgtgggatgttccgtcacctgcagccacacagaaagcggctttgagtgagggagtgtacagaattatgcagaggggcttattcggcaagacccaggtcggggtgggaatccacatggaaggtgttttccacacgatgtggcatgtgactcggggcagcgtcatttgtcacgagaccgggcgactggaaccctcttgggccgacgtgagaaatgatatgatctcctatggaggcggttggcgcctcggggacaaatgggataaggaggaggacgtacaagtgctggcaatagaaccaggaaagaaccccaaacatgttcagacaaagcctggcctttttaaaaccctgacaggcgagattggggccgtcactttggacttcaagccaggaacctcaggtagtcccatcatcaataggaaaggcaaggtgattgggctatacggaaacggcgtggtcacgaaaagcggtgattatgtatccgctataacacaggccgaacgtatcggggagcctgactacgaggtggatgaagacatttttcggaagaagagactgactatcatggatctccacccgggagcaggcaaaaccaagaggattctgccatctatcgttcgcgaggctcttaaacgaagattacggacactgatactcgcccccaccagggtggtcgcggccgaaatggaggaagcattgcgcggcctgcctatccgttatcagactccagctgtgaagtcggagcataccgggagagagattgttgacctcatgtgccacgccacattcacgactcggctgcttagctcaaccagggtgcccaattacaacctgatcgtcatggatgaagctcactttacagacccttccagtgtggcagcccgcggatacatttctacccgagtagagatgggtgaagccgctgcgatcttcatgactgcaacaccgcccggcgccaccgatccatttcctcaaagcaattcccccatagaggacattgaaagagagatcccagagcggtcatggaacacggggttcgattggatcactgactatcagggaaaaacagtgtggtttgttccttctattaaggctggcaatgacatcgccaactgcttgaggaagagcggtaaaaaggtcatacagctaagtcgcaaaaccttcgataccgaataccccaagactaaactgacagactgggattttgtggtgaccacagacatttccgagatgggggcaaacttcagagccggcagggtcatcgatccacggcgttgtctcaagccggttattttaactgacggacctgaacgcgtgatcctggctggccccataccagtaacgcccgcgagcgccgcacaacgaagagggaggattggacggaatcctgctcaggaggatgaccagtatgtgttctctggtgatccacttaagaacgacgaagatcatgcccactggaccgaggcaaaaatgctgctcgacaatatctacacacccgagggcatcattcctactttgtttgggccggaacgcgagaagacccaggccatcgatggagaattcagactgaggggcgagcaacggaaaacatttgtcgagctcatgcgaagaggtgacctgccagtgtggctttcatataaggttgcttccgccgggattagttacaaagaccgcgaatggtgcttcaccggcgagaggaacaatcagatactagaagagaacatggaagtggagatctggactcgggagggagaaaagaagaaactgcgtcccaagtggttggatgcgagagtctatgcagaccctatggccttaaaagattttaaggagttcgctagcggcaggaaatcgattacgctggacatcctcaccgaaatcgcctctctgcccacatacctttccagccgcgctaagctggcactcgataatattgtaatgttgcatactaccgagcgggggggacgagcctaccagcacgctctgaacgaactaccagagtcactggagacactcatgcttgtggccctgttaggtgcaatgaccgcgggcatatttttgttctttatgcaggggaagggaatcggcaaactgagtatgggtctcattactatcgccgttgcttctgggctgctttgggtggccgaaattcaacctcagtggatcgcagcttccataatcctggagttctttctcatggtcttgctgattcccgaaccagagaagcagagaacacctcaggacaatcaattaatctatgtgattctaacgatcctgaccataattggcctcatcgccgcaaacgaaatgggacttattgagaaaactaagacagatttcggcttttaccaggtcaaaaccgagaccacaatcctggacgtggatttgaggccggccagcgcttggactctgtatgcggttgccacgaccatactcacacccatgctgcgccacactatcgaaaatacctcagcaaaccttagtctcgctgccattgccaatcaggcagctgtgctgatggggttgggaaagggctggccactgcatcggatggacttaggtgtacctctactggccatggggtgttacagccaggtgaaccccacaaccctcactgcgtcccttgtcatgctgttggttcactatgctatcattggaccaggcctgcaagccaaagcaacgagagaggcccagaagcgtacagctgcaggtatcatgaagaatcctaccgtggatggcataactgtcattgacctcgaacccatctcttacgatccgaaattcgagaagcagctggggcaagtgatgcttttagtactgtgcgccggacagctcttgctgatgaggaccacatgggcgttctgtgaggtgctaactctggctaccggcccaatcctcacactttgggaagggaaccctggacggttttggaacacgaccattgccgttagcactgcaaatatcttccgcggctcctatctggccggtgctgggttggccttttcactgataaaaaacgcacagacaccccgaagaggaaccggcactacaggtgagaccctcggcgaaaagtggaaaaggcagctgaattctttagaccggaaggagttcgaagagtacaagcgcagtgggattcttgaggtggacagaacggaagctaaatcggccctgaaggatggaagcaaaatcaagcatgcggtctccaggggctcttcaaaaattcgatggatcgtggagcgggggatggtcaagccaaagggaaaagtggttgacctcggctgcggtcgtgggggatggagctactatatggccaccctaaagaacgtaacagaagtgaaaggctacactaagggcgggcccggacacgaggaacctataccgatggcaacctatggttggaatctggtcaaattgcattccggcgtggatgttttttacaagcccacagagcaagtggacactctgctctgtgatatcggggagagttctagcaacccaaccattgaagagggaagaacacttcgcgtcctgaagatggtggaaccttggttgtcatccaaacccgagttctgcatcaaggtactgaatccttatatgccaaccgtgattgaagagctcgagaaattacagaggaagcacggcggtaacctggttcggtgtccccttagtagaaatagcactcacgaaatgtactgggtctctggggcttccggaaacatcgtgtcaagcgtgaatacgacatcgaaaatgctgctaaaccgctttaccactaggcatcgaaagcctacctatgagaaagacgtcgatctcggcgccggcacacggtctgttagtacggaaaccgagaagccagacatgactattatcgggagaaggctgcagcgcttgcaggaggaacacaaggagacatggcattacgatcaagaaaatccctaccgtacctgggcatatcacggatcctacgaggctccgagcactggttcagcctcctctatggtgaacggcgtagtgaaactgctcacaaagccttgggacgtcataccaatggtgacccagcttgccatgacagatactacccccttcgggcagcagcgggtttttaaagaaaaggtggacacgagaacccctcaaccaaaacccggaacaaggatggtcatgactaccacagcgaattggctgtgggctttactgggcaagaagaaaaacccgcgcttgtgcactcgagaggagttcattagcaaggtgcggagtaatgcagccatcggtgctgtatttcaggaagagcaggggtggacctccgccagcgaagcagttaacgactctagattctgggagctcgtggataaagaaagggccctgcaccaagagggaaagtgtgagtcatgcgtctataacatgatgggcaaacgcgaaaagaagctaggcgagtttgggagagctaaaggaagtcgggcgatctggtacatgtggcttggtgccaggttcctggaattcgaggcactcggctttctgaatgaagaccattggttcgggcgtgagaactcctggagcggagtggagggcgaaggtttgcaccgactggggtatattctcgaggaaatagataagaaagacggagatcttatgtacgctgacgatacggccggctgggacacacgcatcaccgaggatgacctgcagaatgaggaattaattactgagcagatggcacctcatcacaagatcctggccaaagctatttttaagttgacatatcagaacaaggtggtcaaagttctcagacccaccccacggggcgccgtgatggatatcatatctaggaaggaccaacgcgggtcgggacaggtaggtacttacggcctgaataccttcacaaacatggaagtgcagctaatcagacagatggaggcggaaggggtcattacgcaagatgacatgcagaatcctaaaggacttaaggagcgggtggagaaatggctgagggaatgcggcgttgaccgactcaagcgtatggcaatctcaggtgatgactgtgtggtcaaacccctggatgagagatttgggaccagcttgttattcctgaacgacatgggaaaggtgcgcaaggatattccacagtgggaaccctccaaaggctggaagaattggcaggaggtacctttttgcagtcatcacttccacaaaatctttatgaaggacggccggtctctcgttgtgccatgtaggaaccaagatgaacttatagggagagcccgcattagccagggagctggttggtccctgcgggagactgcctgcctaggcaaagcatacgctcagatgtggtcactgatgtatttccataggcgagacctcagattggccagtatggctatctgttctgccgtcccgacagagtggtttcccaccagccggactacatggtccatccacgcacatcaccagtggatgaccacggaagatatgctgaaggtgtggaatagggtttggattgaggacaaccctaatatgatagataagacaccagtgcactcatgggaagacatcccctaccttgggaaacgcgaggacctgtggtgcggaagcctcattggcttatcttcccgtgcgacctgggccaagaacatccatactgctattgcccaagtcagaaatctgatcggtaaagaagagtatgtggattacatgcctgtaatgaagcgatatagtgcaccaagcgagtcggaaggggtgttgtga

SEQ ID NO: 15803 - RNA, 9867 nt, synthetic construct
  misc_feature 1..9867: note = derived and/or modified CDS sequence (opt3) from DENV-4__HQ332172__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctgcctgggtaatgtatggcacatgcacccagtcaggggagcgccgacgtgaaaagagaagtgtggcgttgacgcctcacagcggaatgggcctcgagactagggctgaaacctggatgtcctctgagggtgcctggaaacatgcacaacgggtcgagtcgtggattctgcgcaatccagggttcgccctgctcgctggatttatggcatacatgatcggccagacaggcatacagagaactgtgttctttgttttaatgatgctggtggccccctcatatgggatgaggtgtgtcggagtgggtaaccgggatttcgtagaaggcgttagcgggggagcttgggtggaccttgtcttggagcacggcggttgcgtgaccacaatggcccaggggaagcctaccctggattttgaactaacgaagactacagcgaaagaggtggcactcctgcgcacctactgtatcgaagcccttattagtaatatcactacagctacccgatgcccaacgcaaggagagccctatctgaaggaggaacaggaccagcagtacatttgtagaagggatgtcgttgaccggggctggggcaacgggtgcggattgttcggtaaaggcggggtggtaacctgcgccaagttttcctgttctggaaaaatcacaggcaatctcgtgcaaatagagaacctggaatatactgtcgtggttaccgtgcataatggtgatacacacgcagtcgggaacgacactagcaatcacggcgtgaccgctacaattacccctcgttccccatcagtagaggttaagttaccggattacggagaactgactctcgactgcgagccccgcagtggcatcgacttcaacgagatgattcttatgaagatgaaaaagaaaacgtggctggtgcataagcagtggtttttggatctacctctgccatggacaaccggggccgacactagcgaagtccactggaattacaaagagagaatggtgaccttcaaggtcccccatgcgaaaaggcaggatgtgacagttctcggatctcaggaaggtgccatgcactccgcactggctggcgccaccgaggtggactcaggggatggaaaccacatgtttgctggccatcttaagtgtaaggtacggatggaaaaactgcgaatcaagggtatgagctatactatgtgcagtgggaaattctctatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatctccgctactcccttggcggagaacacaaacagcgttaccaatattgagctcgaaccgcctttcggagactcgtatatcgtcataggtgtgggcaactctgcactgacattacattggtttaggaaagggtcctcaattggaaagatgttcgagagtacttaccggggcgccaaacgcatggctatcctgggtgaaaccgcctgggattttgggagcgtgggcggactattcacgtccctcggcaaggcagtccaccaggtttttgggtctgtgtataccacaatgttcggaggcgtgagctggatgatcagaattctgatcggttttcttgtattgtggattgggactaattcaaggaacaccagtatggccatgacatgcatagctgtcggaggcatcactctgttcctcggttttaccgtgcaggccgacatgggctgtgttgtgtcctggagcgggcgtgagctgaagtgcggatctggcattttcgtcgtggataatgttcatacgtggacagaacaatacaaatttcagcccgagtcaccagcacggcttgcgagtgctatcctgaacgcccacaaggacggggtgtgtggaatccgaagcaccactagattggagaatgtaatgtggaaacagattacaaacgaactcaattatgtcctgtgggagggcggtcacgacttaaccgtggtggcaggggatgtcaagggagttctgactaaaggcaagagggccctaacccctcccgcttccgacctcaagtactcttggaaaacatggggtaaggccaaaatattcacgccagaagcacgcaactcgacctttctgatcgatggccccgacactagcgagtgccctaatgaacggagagcttggaactccttcgaggtggaggattacgggttcggaatgtttacaaccaatatttggatgaagttcagggaaggctcaagtgaggtatgtgaccatcgccttatgtctgccgcgatcaaagatcagaaggccgtgcacgctgacatggggtattggattgaaagctccaaaaaccaaacatggcagatcgagcgagcatcattgatagaagtcaagacttgcctgtggccaaagacccatacgctctggagcaatggagtgctggagtctcagatgttaatcccgaaatcctacgccggcccctttagtcagcacaactatcggcaaggttacgctacacagaccgttgggccttggcacctgggaaagcttgagattgatttcggcgaatgcccaggtactaccgtgacaatccaggagaactgtgaccatcgtggccccagcttgagaactaccacagcctctgggaaactcgtcacgcagtggtgctgtaggtcctgcaccatgcctccactgcgctttctaggagaagatggctgttggtatgggatggagattcggcccctgtcagagaaggaagagaatatggtgaaaagtcaagttactgcaggacagggcacaagcgaaaccttctcgatgggtctcctgtgccttactttgtttgtggaggaatgtctgagaaggcgagtcacacgcaagcacatgatcttagcggtagtgataaccctctgcgccattatcctggggggacttacgtggatggacctgttgcgggctctcattatgctgggcgatactatgtccggcagaatcgggggacagacccatctagccataatggcagttttcaagatgtctccgggttacgtgctgggcgtctttctcaggaaactgacaagccgtgagaccgctcttatggtgatcgggatggccatgactacaaccttgtcaattcctcacgacctgatggagttaatcgacggaattagtctcggcctgatccttctgaagatagtaacacagttcgataacactcaagtgggtaccctagcactctccctgacgtttattcgctctacaatgagcttggtcatggcctggcggaccatcatggctgttctgttcgtggtgactttaatcccactctgtagaacctcctgcctgcagaaacagtcacattgggtcgaaattacagcgcttatcctgggggcccaagcattgcccgtgtatctcatgactctgatgaagggagctagcaggcgaagttggcctctaaatgagggcattatggccgttggcctggtatctcttctcgggtccgccctgttgaaaaacgacgtgcccctggctggaccaatggtcgcaggtggcttactcctggccgcgtacgtgatgagcgggtcgtcagctgatctttctctggaaaaggccgcaaatgttcagtgggacgagatggccgatataaccggaagttcccctatcattgaagtgaagcaggacgaggatggcagcttttctatccgggacgtcgaggaaacgaacatgattacattgctcgtgaaactggctctaatcaccgtaagcggtctgtacccccttgcaataccaatcactatgacactctggtatatgtggcaggtcaagacccaacgctccggggccctgtgggatgtgccgtcacctactgcgacacagaaagctgccttgagtgagggagtttacagaattatgcagaggggcttattcggcaagacccaggtgggggtcggaatccacatggaaggtgtgttccacacgatgtggcatgttactcggggcagcgtgatttgtcacgagaccgggcgactggaaccctcttgggcagacgtcagaaatgatatgatctcctatggaggcggttggcgcctcggggacaaatgggataaggaggaggacgtgcaagtactggccatagaaccaggaaagaaccccaaacatgtgcagacaaagcctggcctttttaaaaccctgacaggcgagattggggctgttactttggacttcaagccaggaacctcaggtagtcccatcatcaataggaaaggcaaggtcattgggctatacggaaacggcgtggtgacgaaaagcggtgattatgtctccgccataacacaggcagaacgtatcggggagcctgactacgaggtagatgaagacatttttcggaagaagagactgactatcatggatctccacccgggagctggcaaaaccaagaggattctgccatctatcgtgcgcgaggcccttaaacgaagattacggacactgatactcgcgcccaccagggttgtggccgcagaaatggaggaagctttgcgcggcctgcctatccgttatcagactccagccgtcaagtcggagcataccgggagagagattgtggacctcatgtgccacgctacattcacgactcggctgcttagctcaaccagggttcccaattacaacctgatcgtgatggatgaagcacactttacagacccttccagtgtcgccgcccgcggatacatttctacccgagtggagatgggtgaagctgcggcaatcttcatgactgccacaccgcccggcgctaccgatccatttcctcaaagcaattcccccatagaggacattgaaagagagatcccagagcggtcatggaacacggggttcgattggatcactgactatcagggaaaaacagtatggtttgtgccttctattaaggccggcaatgacatcgcaaactgcttgaggaagagcggtaaaaaggttatacagctaagtcgcaaaaccttcgataccgaataccccaagactaaactgacagactgggattttgtcgtgaccacagacatttccgagatgggggccaacttcagagctggcagggtgatcgatccacggcgttgtctcaagccggtcattttaactgacggacctgaacgcgttatcctggcgggccccataccagtgacgcccgccagcgcagctcaacgaagagggaggattggacggaatcctgcccaggaggatgaccagtatgtattctctggtgatccacttaagaacgacgaagatcatgcacactggaccgaggccaaaatgctgctcgacaatatctacacacccgagggcatcattcctactttgtttgggccggaacgcgagaagacccaggctatcgatggagaattcagactgaggggcgagcaacggaaaacatttgtggagctcatgcgaagaggtgacctgccagtctggctttcatataaggtggcctccgcggggattagttacaaagaccgcgaatggtgcttcaccggcgagaggaacaatcagatactagaagagaacatggaagttgagatctggactcgggagggagaaaagaagaaactgcgtcccaagtggttggatgcaagagtgtatgccgaccctatggctttaaaagattttaaggagttcgccagcggcaggaaatcgattacgctggacatcctcaccgaaatcgcttctctgcccacatacctttccagccgcgcaaagctggccctcgataatattgtcatgttgcatactaccgagcgggggggacgagcttaccagcacgccctgaacgaactaccagagtcactggagacactcatgcttgtagcactgttaggtgcgatgaccgccggcatatttttgttctttatgcaggggaagggaatcggcaaactgagtatgggtctcattactatcgctgtggcctctgggctgctttgggttgcagaaattcaacctcagtggatcgctgcctccataatcctggagttctttctcatggtgttgctgattcccgaaccagagaagcagagaacacctcaggacaatcaattaatctatgtcattctaacgatcctgaccataattggcctcatcgcagccaacgaaatgggacttattgagaaaactaagacagatttcggcttttaccaggtgaaaaccgagaccacaatcctggacgtcgatttgaggccggctagcgcgtggactctgtatgccgtggcaacgaccatactcacacccatgctgcgccacactatcgaaaatacctcagctaaccttagtctcgccgccattgcaaatcaggctgccatcctgatggggttgggaaagggctggccactgcatcggatggacttaggtgttcctctactggcgatggggtgttacagccaggtgaaccccacaaccctcactgcttcccttgtaatgctgttggtgcactatgccattatcggaccaggcctgcaagcaaaagccacgagagaggctcagaagcgtacagcagccggtataatgaagaatcctaccgtcgatggcattactgttatcgacctcgaacccatctcttacgatccgaaattcgagaagcagctggggcaagtgatgcttttagcgctgtgcgctggacagctcttgctgatgaggaccacatgggccttctgtgaggtcctaactctggcaaccggcccaattctcacactttgggaagggaaccctggacggttttggaacacgaccatcgccgtgagcactgctaatatattccgcggctcctatctggccggtgcagggttggctttttcactgattaaaaacgcccagacaccccgaagaggaaccggcactacaggtgagaccctcggcgaaaagtggaaaaggcagctgaattctttagaccggaaggagttcgaagagtacaagcgcagtgggatccttgaggtagacagaacggaagcgaaatcggccctgaaggatggaagcaaaattaagcatgcagtgtccaggggctcttcaaaaatccgatggatagttgagcgggggatggtgaagccaaagggaaaagtcgtggacctcggctgcggtcgtgggggatggagctactatatggctaccctaaagaacgtcacagaagtgaaaggctacactaagggcgggcccggacacgaggaacctatcccgatggccacctatggttggaatctggttaaattgcattccggcgtagatgtgttttacaagcccacagagcaagtcgacactctgctctgtgatattggggagagttctagcaacccaaccatcgaagagggaagaacacttcgcgtgctgaagatggttgaaccttggttgtcatccaaacccgagttctgcattaaggtgctgaatccttatatgccaaccgtcatcgaagagctcgagaaattacagaggaagcacggcggtaacctggtgcggtgtccccttagtagaaatagcactcacgaaatgtactgggtatctggggcatccggaaacattgtgtcaagcgttaatacgacatcgaaaatgctgctaaaccgctttaccactaggcatcgaaagcctacctatgagaaagacgtcgatctcggcgctggcacacggtctgtgagtacggaaaccgagaagccagacatgactatcatagggagaaggctgcagcgcttgcaggaggaacacaaggagacatggcattacgatcaagaaaatccctaccgtacctgggcctatcacggatcctacgaggccccgagcactggttcagcgtcctctatggtgaacggcgtcgttaaactgctcacaaagccttgggacgtgattccaatggtaacccagcttgctatgacagatactacccccttcgggcagcagcgggtgtttaaagaaaaggtcgacacgagaacccctcaaccaaaacccggaacaaggatggtgatgactaccacagcaaattggctgtgggccttactgggcaagaagaaaaacccgcgcttgtgcactcgagaggagttcatcagcaaggttcggagtaatgctgccatcggtgcagtgtttcaggaagagcaggggtggacctccgccagcgaagctgtcaacgactctagattctgggagctcgtggataaagaaagggcgctgcaccaagagggaaagtgtgagtcatgcgtatataacatgatgggcaaacgcgaaaagaagctaggcgagtttgggagagccaaaggaagtcgggcaatttggtacatgtggcttggtgctaggttcctggaattcgaggccctcggctttctgaatgaagaccattggttcgggcgtgagaactcctggagcggagttgagggcgaaggtttgcaccgactggggtatatactcgaggaaatcgataagaaagacggagatcttatgtacgcagacgatacggccggctgggacacacgcattaccgaggatgacctgcagaatgaggaattaatcactgagcagatggctcctcatcacaagattctggccaaagcgatctttaagttgacatatcagaacaaggtggtcaaagtgctcagacccaccccacggggcgcagtgatggatataatctctaggaaggaccaacgcgggtcgggacaggtcggtacttacggcctgaataccttcacaaacatggaagttcagctaattagacagatggaggccgaaggggtgatcacgcaagatgacatgcagaatcctaaaggacttaaggagcgggtagagaaatggctgagggaatgcggcgtggaccgactcaagcgtatggctatttcaggtgatgactgtgtcgtgaaacccctggatgagagatttgggaccagcttgttattcctgaacgacatgggaaaggttcgcaaggatatcccacagtgggaaccctccaaaggctggaagaattggcaggaggtgcctttttgcagtcatcacttccacaaaatatttatgaaggacggccggtctctcgtcgtgccatgtaggaaccaagatgaacttattgggagagcccgcatcagccagggagcaggttggtccctgcgggagactgcttgcctaggcaaagcctacgctcagatgtggtcactgatgtatttccataggcgagacctcagattggccagtatggcaatctgttctgcggtaccgacagagtggtttcccaccagccggactacatggtccattcacgcccatcaccagtggatgaccacggaagatatgctgaaggtttggaatagggtgtggatagaggacaaccctaatatgatcgataagacaccagtccactcatgggaagacattccctaccttgggaaacgcgaggacctgtggtgcggaagcctcatcggcttatcttcccgtgctacctgggccaagaacattcatactgcaatcacccaagtgagaaatctgataggtaaagaagagtatgttgattacatgcctgtgatgaagcgatatagtgctccaagcgagtcggaaggggtcttgtga

SEQ ID NO: 15804 - RNA, 9867 nt, synthetic construct
  misc_feature 1..9867: note = derived and/or modified CDS sequence (opt3) from DENV-4__HQ332176__SS-prME
  source 1..9867: mol_type = other RNA
agcaccatcacactgctctgccttattcccactgtgatggccttccacctgtccacgagagacggcgagcctttgatgatagtcgctaggcatgaacgggggcgcccattactgtttaagaccacagagggaatcaacaaatgtactctaattgcaatggatctcggtgaaatgtgcgaggacaccgttacatacaagtgtccgctgcttgtgaataccgaacccgaggatatcgactgctggtgtaacctgacttctacatgggtaatgtatggcacctgcacgcagtcaggggagcgacgtagagaaaaaaggagtgtggccttgactcctcacagcggaatgggcctcgagacccgggcggaaacatggatgtcctctgagggtgcttggaagcatgcccaacgcgtcgagtcgtggattctgagaaatccagggttcgcactgctcgccggatttatggcttacatgatcggccagactggcatacagaggaccgtgttctttgttttaatgatgctggtggcaccctcatatgggatgcggtgtgtcggagtgggtaaccgcgatttcgtagaaggcgttagcgggggagcctgggtggaccttgtcttggagcacggcggttgcgtgacaaccatggctcaggggaaacctacgctggattttgaactaactaagacaaccgccaaggaggtggcgctcctgcgaacttactgtatcgaagcacttattagtaatatcacaaccgccacgagatgcccaacccaaggagagccctatctgaaagaggaacaggaccagcagtacatttgtaggcgggatgtcgttgaccgtggctggggcaacgggtgcggattgttcggtaagggcggggtggtaacatgcgctaaattttcctgttctggaaagatcactggcaatctcgtgcaaatagagaacctggaatataccgtcgtggttacagtgcataatggtgatactcacgccgtcgggaacgacaccagcaatcacggcgtgacagcaaccattactcctcgctccccatcagtagaggttaaattaccggattacggagaactgacgctcgactgcgagcccagaagtggcatcgacttcaacgagatgattcttatgaagatgaagaaaaagacatggctggtgcataaacagtggtttttggatctacctctgccatggaccactggggctgacaccagcgaagtccactggaattacaaggagaggatggtgacattcaaagtcccccatgccaagcggcaggatgtgaccgttctcggatctcaggaaggtgcgatgcactccgccctggcaggcgctactgaggtggactcaggggatggaaaccacatgtttgccggccatcttaaatgtaaggtacgaatggaaaagctgcgcatcaaaggtatgagctatacaatgtgcagtgggaagttctctatcgacaaagagatggctgagacgcaacacggcaccactgtcgtgaaggttaaatacgaaggagccggcgcaccttgtaaggtgccaattgagataagagatgtcaataaggaaaaagtggtagggagggtgatctccgccacacccttggctgagaacaccaacagcgttacaaatattgagctcgaaccgcctttcggagactcgtatatcgtcataggtgtgggcaactctgcgctgactttacattggtttcggaaggggtcctcaattggaaaaatgttcgagagtacctaccgcggcgcaaagagaatggccatcctgggtgaaacggcttgggattttgggagcgtgggcggactattcacctccctcggcaaagccgtccaccaggtttttgggtctgtgtatacaactatgttcggaggcgtgagctggatgatcaggattctgatcggttttcttgtattgtggattgggaccaattcacgtaacacaagtatggcaatgacttgcatagccgtcggaggcatcaccctgttcctcggttttacggtgcaggctgacatgggctgtgttgtgtcctggagcgggcgggagctgaagtgcggatctggcattttcgtcgtggataatgttcatacatggaccgaacaatacaagtttcagcccgagtcaccagcccgacttgcaagtgcgatcctgaacgctcacaaagacggggtgtgtggaatcagaagcactacaaggttggagaatgtaatgtggaagcagattaccaacgaactcaattatgtcctgtgggagggcggtcacgacttaactgtggtggccggggatgtcaaaggagttctgaccaagggcaaacgcgcactaacacctcccgcctccgacctcaagtactcttggaagacgtggggtaaagctaagatattcaccccagaagcccggaactcgacttttctgatcgatggccccgacacaagcgagtgccctaatgaaagaagggcatggaactccttcgaggtggaggattacgggttcggaatgtttaccacaaatatttggatgaaattccgcgaaggctcaagtgaggtatgtgaccatcgacttatgtctgctgccatcaaggatcagaaagcggtgcacgccgacatggggtattggattgaaagctccaagaaccaaacttggcagatcgagcgggcttcattgatagaagtcaaaacctgcctgtggccaaagacgcatacactctggagcaatggagtgctggagtctcagatgttaatcccgaagtcctacgcaggcccctttagtcagcacaactatcgtcaaggttacgccacccagactgttgggccttggcacctgggaaaacttgagattgatttcggcgaatgcccaggtaccacagtgactatccaggagaactgtgaccatagaggccccagcttgaggaccacaacggcttctgggaagctcgtcacccagtggtgctgtcgctcctgcactatgcctccactgcggtttctaggagaagatggctgttggtatgggatggagattagacccctgtcagagaaagaagagaatatggtgaagagtcaagttacagccggacagggcaccagcgaaactttctcgatgggtctcctgtgccttacattgtttgtggaggaatgtctgaggcgacgcgtcacccggaaacacatgatcttagcagtagtgataacgctctgcgcgattatcctggggggacttacttggatggacctgttgagagccctcattatgctgggcgataccatgtccggcaggatcgggggacagacacatctagctataatggccgttttcaagatgtctccgggttacgtgctgggcgtctttctccgtaagctgaccagccgcgagactgcacttatggtgatcgggatggctatgacaaccacattgtcaattcctcacgacctgatggagttaatcgacggaattagtctcggcctgatccttctgaaaatagtaactcagttcgataacacccaagtgggtacgctagccctctccctgacatttattcggtctaccatgagcttggtcatggcatggagaactatcatggccgttctgttcgtggtgaccttaatcccactctgtaggacatcctgcctgcagaagcagtcacattgggtcgaaattactgctcttatcctgggggcgcaagccttgcccgtgtatctcatgaccctgatgaaaggagcaagccgacggagttggcctctaaatgagggcattatggctgttggcctggtatctcttctcgggtccgccctgttgaagaacgacgtgcccctggccggaccaatggtcgctggtggcttactcctggcagcctacgtgatgagcgggtcgtcagcggatctttctctggaaaaagctgccaatgttcagtgggacgagatggcagatataacgggaagttcccctatcattgaagtgaagcaggacgaggatggcagcttttctatccgcgacgtcgaggaaacaaacatgattaccttgctcgtgaagctggccctaatcactgtaagcggtctgtacccccttgctataccaatcacaatgaccctctggtatatgtggcaggtcaaaactcaaagatccggggcactgtgggatgtgccgtcacctgccgcgacacagaaggctgccttgagtgagggagtttacaggattatgcagcggggcttattcggcaaaacccaggtgggggtcggaatccacatggaaggtgtgttccacacgatgtggcatgttactcgaggcagcgtgatttgtcacgagaccgggagactggaaccctcttgggcagacgtccgcaatgatatgatctcctatggaggcggttggaggctcggggacaagtgggataaagaggaggacgtgcaagtactggccatagaaccaggaaagaaccccaagcatgtgcagacaaaacctggcctttttaagaccctgacaggcgagattggggctgttactttggacttcaaaccaggaacctcaggtagtcccatcatcaatcgtaagggcaaagtcattgggctatacggaaacggcgtggtgacgaagagcggtgattatgtctccgccataacacaggcagaacggatcggggagcctgactacgaggtagatgaagacatttttagaaaaaagaggctgactatcatggatctccacccgggagctggcaagaccaaacgcattctgccatctatcgtgcgagaggcccttaagagacggttaaggacactgatactcgcgcccacccgcgttgtggccgcagaaatggaggaagctttgcgtggcctgcctatcagatatcagactccagccgtcaaatcggagcataccgggcgggagattgtggacctcatgtgccacgctacattcacgactaggctgcttagctcaacccgcgttcccaattacaacctgatcgtgatggatgaagcacactttacagacccttccagtgtcgccgcccgaggatacatttctaccagagtggagatgggtgaagctgcggcaatcttcatgactgccacaccgcccggcgctaccgatccatttcctcaaagcaattcccccatagaggacattgaacgggagatcccagagaggtcatggaacacggggttcgattggatcactgactatcagggaaagacagtatggtttgtgccttctattaaagccggcaatgacatcgcaaactgcttgcgcaagagcggtaagaaagttatacagctaagtagaaagaccttcgataccgaataccccaaaactaagctgacagactgggattttgtcgtgaccacagacatttccgagatgggggccaacttcagggctggccgggtgatcgatccacgtcgctgtctcaaaccggtcattttaactgacggacctgaacgagttatcctggcgggccccataccagtgacgcccgccagcgcagctcaaagaagggggcggattggacgcaatcctgcccaggaggatgaccagtatgtattctctggtgatccacttaagaacgacgaagatcatgcacactggaccgaggccaagatgctgctcgacaatatctacacacccgagggcatcattcctactttgtttgggccggaaagagagaaaacccaggctatcgatggagaattcaggctgcggggcgagcaacgaaagacatttgtggagctcatgagacgcggtgacctgccagtctggctttcatataaagtggcctccgcggggattagttacaaggacagggaatggtgcttcaccggcgagcggaacaatcagatactagaagagaacatggaagttgagatctggactcgtgagggagaaaaaaagaagctgagacccaaatggttggatgcaagggtgtatgccgaccctatggctttaaaggattttaaagagttcgccagcggccgcaagtcgattacgctggacatcctcaccgaaatcgcttctctgcccacatacctttccagccgggcaaaactggccctcgataatattgtcatgttgcatactaccgagcgagggggaagagcttaccagcacgccctgaacgaactaccagagtcactggagacactcatgcttgtagcactgttaggtgcgatgaccgccggcatatttttgttctttatgcaggggaagggaatcggcaagctgagtatgggtctcattactatcgctgtggcctctgggctgctttgggttgcagaaattcaacctcagtggatcgctgcctccataatcctggagttctttctcatggtgttgctgattcccgaaccagagaaacagaggacacctcaggacaatcaattaatctatgtcattctaacgatcctgaccataattggcctcatcgcagccaacgaaatgggacttattgagaagactaaaacagatttcggcttttaccaggtgaagaccgagaccacaatcctggacgtcgatttgcgcccggctagcgcgtggactctgtatgccgtggcaacgaccatactcacacccatgctgcggcacactatcgaaaatacctcagctaaccttagtctcgccgccattgcaaatcaggctgccgttctgatggggttgggaaaaggctggccactgcatagaatggacttaggtgtgcctctactggcgatggggtgttacagccaggtaaaccccacaaccctcactgcttcccttgtgatgctgttggtccactatgccatcattggaccaggcctgcaagcaaaggccacgcgtgaggctcagaaaaggacagcagccggtatcatgaagaatcctaccgttgatggcataactgtgattgacctcgaacccatctcttacgatccgaagttcgagaaacagctggggcaagtcatgcttttagtgctgtgcgcgggacagctcttgctgatgcggaccacatgggctttctgtgaggtactaactctggccaccggcccaatcctcacactttgggaagggaaccctggacgcttttggaacacgaccattgcagtgagcactgccaatatcttccgaggctcctatctggctggtgccgggttggcattttcactgataaagaacgctcagacacccagaaggggaaccggcactacaggtgagaccctcggcgaaaaatggaagcggcagctgaattctttagaccgcaaagagttcgaagagtacaagagaagtgggattcttgaggttgacaggacggaagccaagtcggcgctgaaagatggaagcaagatcaaacatgccgtgtcccgaggctcttcaaagattcggtggatcgtcgagcgtgggatggtgaaaccaaagggaaaggtcgtggacctcggctgcggtagagggggatggagctactatatggcaaccctaaaaaacgttacagaagtaaagggctacactaaaggcgggcccggacacgaggaacctataccgatggctacctatggttggaatctggtgaagttgcattccggcgtcgatgtgttttacaaacccacagagcaagttgacactctgctctgtgatatcggggagagttctagcaacccaaccattgaagagggacgcacacttagggtgctgaagatggtcgaaccttggttgtcatccaagcccgagttctgcatcaaagtgctgaatccttatatgccaaccgtaattgaagagctcgagaagttacagcggaaacacggcggtaacctggtgagatgtccccttagtcgcaatagcactcacgaaatgtactgggtttctggggcctccggaaacatcgtctcaagcgtgaatacgacatcgaagatgctgctaaacaggtttaccactcgacatcggaaaccttcttatgagaaggacgtggatctcggcgcaggcaccagaagtgtctccacagaaacggagaaaccagacatgaccattatcgggaggcgcctgcagcgtttgcaggaggaacacaaggagacttggcattacgatcaagaaaatccctaccggacatgggcttatcacggaagctacgaggccccgtcaaccggttccgcctctagcatggttaacggcgtggtaaagctgctcactaaaccttgggacgtgataccaatggtcacacagcttgcgatgaccgatacaactcccttcgggcagcagagagtgtttaaggaaaaagttgacaccaggacgcctcaaccaaagcccggaacccgcatggtgatgacaactaccgctaattggctgtgggcattactgggcaaaaagaagaacccgcgattgtgcacacgggaggagttcattagtaaagtcagatccaatgccgctatcggtgccgtgtttcaggaagagcaggggtggactagcgcatctgaagccgtaaacgactcaaggttctgggagctcgttgataaggaacgcgctctgcaccaagagggaaaatgtgagagttgcgtgtataacatgatgggcaagagagaaaaaaagctaggcgagtttgggcgggcgaagggatccagggccatctggtacatgtggcttggtgcacgtttcctggaattcgaggctctcggctttctgaatgaagaccattggttcgggcgagagaacagctggtctggagtcgagggcgaaggtttgcaccgcctggggtatattctcgaggaaatagataaaaaggacggagatcttatgtacgccgacgataccgcaggctgggacacgagaatcacagaggatgacctgcagaatgaggaattaattaccgagcagatggcccctcatcacaaaatcctggctaaggccatttttaaattgacttatcagaacaaggtggtgaaggtcctccggcccacaccaaggggcgcggttatggatatcatatcgcgcaaagaccaaagagggtcaggacaggtgggtacctacggcctgaatactttcaccaacatggaagtacagctaatccggcagatggaggcagaaggggtgattacacaagatgacatgcagaatcctaagggacttaaagagagggtcgagaagtggctgcgagaatgcggcgtggaccgtctcaaaagaatggccatcagcggtgatgactgtgttgtgaagcccctggatgagcgctttgggacgtccttgttattcctgaacgacatgggaaaagtccggaaggatattccacagtgggaacccagtaagggctggaaaaattggcaggaggtgcctttttgctctcatcacttccacaagatctttatgaaagacggcaggagcctcgtagttccatgtagaaaccaagatgaacttatagggcgcgctcggatttcccagggagccggttggtcactgagggagaccgcatgcctaggcaaggcttacgcccagatgtggagtctgatgtatttccatcgaagagacctccggttggcttctatggccatctgtagcgcagtgccgactgagtggtttcccacatccaggaccacttggtcaatccacgcgcatcaccagtggatgacaaccgaagatatgctgaaagtctggaatcgcgtgtggattgaggacaaccctaatatgatagataagacgccagttcacagctgggaagacatcccctaccttgggaagcgtgaggacctgtggtgcggatctctcattggcttatccagtagagccacatgggctaaaaacatccataccgccattactcaagtgcgaaatctgatcggtaaggaagagtatgtcgattacatgcctgtgatgaaaaggtatagcgcaccatcggagtccgaaggggtattgtga

SEQ ID NO: 15805 - RNA, 9867 nt, synthetic construct
  misc_feature 1..9867: note = derived and/or modified CDS sequence (opt3) from DENV-4__HQ332174__SS-prME
  source 1..9867: mol_type = other RNA
agcaccatcacactgctctgccttattcccactgccatggctttccacctgtccacgagagacggcgagcctttgatgatagtggcaaagcatgaaagggggcggccattactgtttaaaaccacagagggaatcaacaagtgtactctaattgccatggatctcggtgaaatgtgcgaggacaccgtcacatacaaatgtccgctgcttgttaataccgaacccgaggatatcgactgctggtgtaacctgacttctacatgggtgatgtatggcacctgcacgcagtcaggggagcgccgacgtgaaaagagaagtgtagcgttgactcctcacagcggaatgggcctcgagaccagggctgaaacatggatgtcctctgagggtgcctggaaacatgcacaacgggtggagtcgtggattctgcgcaatccagggttcgccctgctcgctggatttatggcatacatgatcggccagactggcatacagagaaccgtcttctttgtgttaatgatgctggttgccccctcatatgggatgaggtgtgtgggagtcggtaaccgggatttcgtggaaggcgtaagcgggggagcttgggttgaccttgtgttggagcacggcggttgcgtcacaaccatggcccaggggaagcctacgctggattttgaactaactaagacaaccgcgaaagaggtggcactcctgcgcacttactgtatcgaagcccttattagtaatatcacaaccgctacgcgatgcccaacccaaggagagccctatctgaaggaggaacaggaccagcagtacatttgtagaagggatgtggtcgaccggggctggggcaacgggtgcggattgttcggtaaaggcggggttgtgacatgcgccaagttttcctgttctggaaaaatcactggcaatctcgtacaaatagagaacctggaatataccgtggtcgtgacagttcataatggtgatactcacgcagtggggaacgacaccagcaatcacggcgtcacagctaccattactcctcgttccccatcagtggaggtaaagttaccggattacggagaactgacgctcgactgcgagccccgcagtggcatcgacttcaacgagatgattcttatgaagatgaaaaagaaaacatggctggttcataagcagtggtttttggatctacctctgccatggaccactggggccgacaccagcgaagtgcactggaattacaaagagagaatggtcacattcaaggtgccccatgcgaaaaggcaggatgtcaccgtgctcggatctcaggaaggtgccatgcactccgcactggctggcgccactgaggttgactcaggggatggaaaccacatgtttgctggccatcttaagtgtaaggtgcggatggaaaaactgcgaatcaagggtatgagctatacaatgtgcagtgggaaattctctatcgacaaggagatggccgagacgcaacacggcaccactgtagtcaaagtgaagtacgaaggagcaggcgccccttgtaaggttccaattgagatacgcgatgtgaataaagaaaaggtcgtggggagagtaatctccgctacacccttggcggagaacaccaacagcgtgacaaatattgagctcgaaccgcctttcggagactcgtatatcgttataggtgtcggcaactctgcactgactttacattggtttaggaaagggtcctcaattggaaagatgttcgagagtacctaccggggcgccaaacgcatggctatcctgggtgaaacggcctgggattttgggagcgtgggcggactattcacctccctcggcaaggcagtgcaccaggtctttgggtctgtttatacaactatgttcggaggcgtgagctggatgatcagaattctgatcggttttcttgtgttgtggattgggaccaattcaaggaacacaagtatggccatgacttgcatagctgtaggaggcatcaccctgttcctcggttttacggtccaggccgacatgggctgtgtggtttcctggagcgggcgtgagctgaagtgcggatctggcattttcgtggtcgataatgtgcatacatggaccgaacaatacaaatttcagcccgagtcaccagcacggcttgcgagtgctatcctgaacgcccacaaggacggggtttgtggaatccgaagcactacaagattggagaatgtgatgtggaaacagattaccaacgaactcaattatgtactgtgggagggcggtcacgacttaactgtcgtggcaggggatgtgaagggagtcctgaccaaaggcaagagggccctaacacctcccgcttccgacctcaagtactcttggaaaacgtggggtaaggccaaaatattcaccccagaagcacgcaactcgacttttctgatcgatggccccgacacaagcgagtgccctaatgaacggagagcttggaactccttcgaggttgaggattacgggttcggaatgtttaccacaaatatttggatgaagttcagggaaggctcaagtgaggtgtgtgaccatcgccttatgtctgccgcgatcaaagatcagaaggccgtacacgctgacatggggtattggattgaaagctccaaaaaccaaacttggcagatcgagcgagcatcattgatagaagtgaagacctgcctgtggccaaagacgcatacactctggagcaatggagtcctggagtctcagatgttaatcccgaaatcctacgccggcccctttagtcagcacaactatcggcaaggttacgctacccagactatggggccttggcacctgggaaagcttgagattgatttcggcgaatgcccaggtaccacagtgactatccaggagaactgtgaccatcgtggccccagcttgagaaccacaacggcctctgggaaactcgttacccagtggtgctgtaggtcctgcactatgcctccactgcgctttctaggagaagatggctgttggtatgggatggagattcggcccctgtcagagaaggaagagaatatggtgaaaagtcaagtcacagcaggacagggcgcgagcgaaaccttctcgatgggtctcctgtgccttactttgtttgtggaggaatgtctgagaaggcgagttacacgcaagcacatgatcttagccgtggtcataaccctctgcgctattatcctggggggacttacgtggatggacctgttgcgggccctcattatgctgggcgatactatgtccggcagaatcgggggacagacccatctagcaataatggctgtattcaagatgtctccgggttacgtgctgggcgtttttctcaggaaactgacaagccgtgagaccgcccttatggtgatcgggatggcaatgactacaaccttgtcaattcctcacgacctgatggagttaatcgacggaattagtctcggcctgatccttctgaagatagtcacacagttcgataacactcaagtgggtaccctagccctctccctgacgtttattcgctctacaatgagcttggtaatggcttggcggaccatcatggcggtgctgttcgtcgttactttaatcccactctgtagaacctcctgcctgcagaaacagtcacattgggtggaaattacagcccttatcctgggggcacaagctttgcccgtgtatctcatgactctgatgaagggagccagcaggcgaagttggcctctaaatgagggcattatggccgtcggcctggtgtctcttctcgggtccgctctgttgaaaaacgacgttcccctggcaggaccaatggtagccggtggcttactcctggcggcttacgtgatgagcgggtcgtcagccgatctttctctggaaaaggcagccaatgtccagtgggacgagatggctgatataaccggaagttcccctatcattgaagtgaagcaggacgaggatggcagcttttctatccgggacgttgaggaaacgaacatgattacattgctcgtgaaactggcactaatcaccgtcagcggtctgtacccccttgccataccaatcactatgacactctggtatatgtggcaggtgaagacccaacgctccggggcgctgtgggatgtaccgtcacctgctgccactcagaaagcagccttgagtgagggagtctacagaattatgcagaggggcttattcggcaagacacaggtgggggttggaatccacatggaaggtgtgttccacaccatgtggcatgtcacgcggggcagcgtgatttgtcacgagactgggcgactggaaccctcttgggctgacgttagaaatgatatgatctcctatggaggcggttggcgcctcggggacaaatgggataaggaggaggacgtgcaagtcctggccatagaaccaggaaagaaccccaaacatgtgcagaccaagcctggcctttttaaaacactgaccggcgagattggggcagtaacattggacttcaagccaggaacttcaggtagtcccatcatcaataggaaaggcaaggtgattgggctatacggaaacggcgttgtcaccaaaagcggtgattatgtgtccgctataacgcaggccgaacgtatcggggagcctgactacgaggtggatgaagacatttttcggaagaagagactgacaatcatggatctccacccgggagcgggcaaaactaagaggattctgccatctatcgtccgcgaggcccttaaacgaagattacggaccctgatactcgcacccacaagggtagtggctgccgaaatggaggaagctttgcgcggcctgcctatccgttatcagaccccagcagttaagtcggagcatactgggagagagattgtggacctcatgtgccacgccaccttcacaacgcggctgcttagctcaactagggtccccaattacaacctgatcgtgatggatgaagcccactttaccgacccttccagtgttgctgcgcgcggatacatttctacacgagtggagatgggtgaagcagccgctatcttcatgaccgccactccgcccggcgcaacagatccatttcctcaaagcaattcccccatagaggacattgaaagagagatcccagagcggtcatggaacaccgggttcgattggatcacggactatcagggaaaaactgtctggtttgtgccttctattaaggccggcaatgacatcgctaactgcttgaggaagagcggtaaaaaggtaatacagctaagtcgcaaaacattcgataccgaataccccaagaccaaactgactgactgggattttgtggttacaaccgacatttccgagatgggggcgaacttcagagccggcagggtcatcgatccacggcgttgtctcaagccggtgattttaacagacggacctgaacgcgtgatcctggcaggccccataccagtcactcccgctagcgccgcacaacgaagagggaggattggacggaatcctgcccaggaggatgaccagtatgttttctctggtgatccacttaagaacgacgaagatcatgctcactggacggaggccaaaatgctgctcgacaatatctacacccccgagggcatcattcctacattgtttgggccggaacgcgagaagactcaggcgatcgatggagaattcagactgaggggcgagcaacggaaaacctttgtggagctcatgcgaagaggtgacctgccagtatggctttcatataaggtggcatccgccgggattagttacaaagaccgcgaatggtgcttcacaggcgagaggaacaatcagatactagaagagaacatggaagtcgagatctggacccgggagggagaaaagaagaaactgcgtcccaagtggttggatgctagagtgtatgccgaccctatggctttaaaagattttaaggagttcgcaagcggcaggaaatcgattactctggacatcctcacggaaatcgcctctctgcccacctacctttccagccgcgctaagctggccctcgataatattgttatgttgcatacaactgagcgggggggacgagcataccagcacgcgctgaacgaactaccagagtcactggagaccctcatgcttgtggccctgttaggtgctatgacagccggcatatttttgttctttatgcaggggaagggaatcggcaaactgagtatgggtctcattaccatcgcagtcgcttctgggctgctttgggtagccgaaattcaacctcagtggatcgcagcctccataatcctggagttctttctcatggtgttgctgattcccgaaccagagaagcagagaactcctcaggacaatcaattaatctatgttattctaacaatcctgacgataattggcctcatcgctgcgaacgaaatgggacttattgagaaaaccaagactgatttcggcttttaccaggccaaaacagagaccaccatcctggacgtggatttgaggccggcaagcgcttggacactgtatgccgtcgccactacgatactcacccccatgctgcgccacacaatcgaaaatacttcagcaaaccttagtctcgctgccattgcgaatcaggctgccgtgctgatggggttgggaaagggctggccactgcatcggatggacttaggtgtccctctactggcaatggggtgttacagccaggtgaaccccaccacactcaccgcctcccttgttatgctgttggtgcactatgctatcattggaccaggcctgcaagcaaaagccactagagaggcgcagaagcgtacggctgccggtatcatgaagaatcctacagtagatggcataaccgtgattgacctcgaacccatctcttacgatccgaaattcgagaagcagctggggcaagtcatgcttttagttctgtgcgcaggacagctcttgctgatgaggactacctgggccttctgtgaggtgctaacactggctactggcccaatcctcaccctttgggaagggaaccctggacggttttggaacacaacgattgccgtcagcaccgcaaatatcttccgcggctcctatctggctggtgccgggttggcgttttcactgataaaaaacgcccagactccccgaagaggaacaggcaccactggtgagacactcggcgaaaagtggaaaaggcagctgaattctttagaccggaaggagttcgaagagtacaagcgcagtgggattcttgaggtggacagaaccgaagcaaaatcggctctgaaggatggaagcaaaatcaagcatgccgtatccaggggctcttcaaaaattcgatggatcgtggagcgggggatggttaagccaaagggaaaagtggtcgacctcggctgcggtcgtgggggatggagctactatatggcaacgctaaagaacgtgaccgaagtcaaaggctacacaaagggcgggcccggacacgaggaacctataccgatggctacttatggttggaatctggtgaaattgcattccggcgttgatgtattttacaagcccaccgagcaagtggacacactgctctgtgatatcggggagagttctagcaacccaactattgaagagggaagaacccttcgcgtcctgaagatggtggaaccttggttgtcatccaaacccgagttctgcatcaaggttctgaatccttatatgccaacagtgattgaagagctcgagaaattacagaggaagcacggcggtaacctggtccggtgtccccttagtagaaatagcacccacgaaatgtactgggtgtctggggcctccggaaacatcgtatcaagcgtgaatactacgtcgaaaatgctgctaaaccgctttacaaccaggcatcgaaagcctacttatgagaaagacgttgatctcggcgccggcacccggtctgtcagtacagaaacggagaagccagacatgaccattatcgggagaaggctgcagcgcttgcaggaggaacacaaggagacttggcattacgatcaagaaaatccctaccgtacatgggcgtatcacggatcctacgaggctccgagcaccggttcagcatcctctatggtgaacggcgtggtcaaactgctcactaagccttgggacgttataccaatggtgacacagcttgccatgaccgatacaactcccttcgggcagcagcgggtatttaaagaaaaggtggacaccagaacgcctcaaccaaaacccggaaccaggacagtcatgactaccacagctaattggctgtgggccttactgggcaagaagaaaaacccgcgcttgtgcactcgagaggagttcattagcaaggtgcggagtaatgcagccatcggtgctgtttttcaggaagagcaggggtggacctccgcgagcgaagccgtgaacgactctagattctgggagctcgtcgataaagaaagggcactgcaccaagagggaaagtgtgagtcatgcgtgtataacatgatgggcaaacgcgaaaagaagctaggcgagtttgggagagctaaaggaagtcgggccatctggtacatgtggcttggtgcaaggttcctggaattcgaggccctcggctttctgaatgaagaccattggttcgggcgtgagaactcctggagcggagtagagggcgaaggtttgcaccgactggggtatattctcgaggaaatagataagaaagacggagatcttatgtacgctgacgatacggccggctgggacacacgcatcaccgaggatgacctgcagaatgaggaattaattactgagcagatggcgcctcatcacaagatcctggcaaaagccatttttaagttgacatatcagaacaaggttgtgaaagtcctcagacccaccccacggggcgctgtgatggatatcatatctaggaaggaccaacgcgggtcgggacaggtgggtacttacggcctgaataccttcacaaacatggaagtccagctaatcagacagatggaggccgaaggggttattacgcaagatgacatgcagaatcctaaaggacttaaggagcgggtggagaaatggctgagggaatgcggcgtagaccgactcaagcgtatggcaatctcaggtgatgactgtgtggtcaaacccctggatgagagatttgggaccagcttgttattcctgaacgacatgggaaaggtgcgcaaggatattccacagtgggaaccctccaaaggctggaagaattggcaggaggttcctttttgcagtcatcacttccacaaaatctttatgaaggacggccggtctctcgtggtcccatgtaggaaccaagatgaacttatagggagagctcgcattagccagggagccggttggtccctgcgggagactgcttgcctaggcaaagcctacgcacagatgtggtcactgatgtatttccataggcgagacctcagattggcgagtatggccatctgttctgctgtgccgacagagtggtttcccaccagccggactacatggtccatccacgcccatcaccagtggatgaccacggaagatatgctgaaggtatggaatagggtttggattgaggacaaccctaatatgatagataagacaccagtgcactcatgggaagacatcccctaccttgggaaacgcgaggacctgtggtgcggaagcctcattggcttatcttcccgtgcaacctgggctaagaacatccatactgccattacccaagtcagaaatctgatcggtaaagaagagtatgtggattacatgcctgttatgaagcgatatagtgcaccaagcgagtcggaaggggtgttgtga

SEQ ID NO: 15806 - RNA, 9867 nt, synthetic construct
  misc_feature 1..9867: note = derived and/or modified CDS sequence (opt3) from DENV-4__KT026308__SS-prME
  source 1..9867: mol_type = other RNA
agcaccatcactctgctctgccttattcccactgtgatggccttccacctgtccacgagagacggcgaacctttgatgatagtcgctaagcatgaaagagggcggccattactgtttaaaaccactgaggggatcaacaagtgtactctaattgcaatggatctcggtgaaatgtgcgaggacaccgttacctacaaatgtccgctgcttgtgaataccgaacccgaggatatcgactgctggtgtaacctgacttctacctgggtgatgtatggaacctgcacgcagtcaggggagcgccgacgtgaaaagagaagtgtggccttgactcctcacagcggaatgggcctcgagaccagagcggaaacatggatgtcctctgagggtgcttggaaacatgcccagcgggtcgagtcgtggattctgcgcaatccagggttcgcactgctcgccggatttatggcttacatgatcggccagactggcattcagagaaccgtgttctttatcttaatgatgctggttgcaccctcatatgggatgaggtgtgtgggagtcggtaaccgggatttcgtggaaggcgtaagcgggggagcctgggttgaccttgtgttggagcacggcggttgcgtcacaaccatggctcaggggaagcctacgctggattttgaactaattaagactacagccaaagaggtggcgctcctgcgcacctactgtatcgaagcaagtatttccaatatcactacagccacccgatgcccaacgcaaggagagccctatcttaaggaggaacaggaccagcagtacatatgtagaagggatatggtggaccggggctggggcaacgggtgcggactgttcggtaaaggcggggtcgttacctgcgctaagttttcttgtttgggaaaaattacaggcaatctcgtgcaaatcgagaacctggaatatactgtagtggtcaccgtgcataatggtgatacacacgccgttgggaacgacactagcaatcacggcgtgaccgcaacaattacccctcgttccccatcagtcgaggtgcagttaccggattacggagaactgactctcgactgcgagccccgcagtggcatcgacttcaacgagatgatccttatgaagatgaagacgaaaacatggctggtacataagcagtggtttttggatctacctctgccatggaccactggggctgacaccctcgaagttcactggaatcataaagagagaatggtgacattcaaggtcccccacgccaaaaggcaggatgtgaccgtcctgggaagccaagaaggtgcgatgcactctgcccttgcaggcgctactgaggtggactccggggatggaaaccatatgtttgccggccacctgaagtgtaaagttcggatggaaaagttgcgaattaagggtatgtcatacacaatgtgcagcgggaaattcagtatagacaaggagatggctgagacgcagcatggcaccactgtggtaaaagtcaagtatgaaggaacaggcgccccttgtaaagtgccaatcgagattcgcgatgttaataaggaaaaggtggtcgggagaatcatatcttccacccccttcgcagagaacacaaacagcgtgactaatattgagctcgaaccgccttttggagactcgtacatcgtaatcggtgtgggcgattctgccctgaccttacactggttcaggaaagggtcctcaattggaaagatgtttgagagtacgtatcggggcgctaaacgcatggcgatcctgggtgaaaccgcatgggacttcgggagcgttggcggactactcacatccctgggcaaggccgtccatcaggtgtttgggtctgtgtacactaccatgttcggaggcgtcagctggatggttaggattcttataggtttgctggtgctctggatcgggacaaactcaaggaatacaagtatggctatgtcctgcattgccgtgggaggcatcaccctgtttcttggtttcacggtacacgcagatatgggctgtgtcgtgagctggtctgggaaagagctgaagtgcggatcaggcatctttgttattgacaacgtgcacacatggaccgaacaatataagttccagcccgagagtccagcccgtttggctagcgccatactcaatgcacataaagagggggtctgtggaatccggtccactacacgactggaaaacgtgatgtggaagcagattaccaatgagttaaactacgttctgtgggaaggcggtcacgacctaactgtggtagcgggggatgtcaaaggagtgctctctaagggcaaaagagctctggcccctcccgtgaatgaccttaagtattcgtggaagacctggggtaaagcaaagatctttacaccagagacgaggaacagcaccttcttggtcgatggccccgacacttccgaatgccctaatgagcgccgggcctggaactttctggaggttgaagattacgggttcggaatgttcacaaccaatatttggatgaaatttagagagggctcaagtgaagtgtgtgaccataggctcatgtctgctgccatcaaggatcagaaagcagtacacgctgacatggggtactggatagagagctccaagaaccaaacatggcagatcgaaaaagcctcactgattgaggtgaagacttgcttatggccaaagacccacacgctgtggagcaatggagtccttgagtctcagatgttgatcccgaaagcgtatgccggccccatttcccagcataactaccgccaaggttatgctacacagaccgcagggccttggcacctcggaaagctggaaatcgatttcggcgagtgcccaggtactaccgtgacagttcaggaagactgtgatcatcgaggccccagtctacggactaccacagccagcgggaaactggtgacgcagtggtgctgtcgttcttgcaccatgcctccactcagatttctgggagaggacggctgttggtacgggatggagataaggccccttaacgaaaaggaggaaaatatggtcaaatcccaagtgtcagctggacacggcacaagtgagacattcagcatgggtttgctgtgcttaaccctctttgttgaagagtgtctgcgccggagagtgactaggaagcatatgattcttgtcgtagtgacaaccctgtgcgccatcattctaggcgggctcacgtggatggatctgctacgagcactgatcatgctcggggacactatgtcgggccgcatgggaggccagatacacctggcgatcatggccgttttcaagatgtccccgggttatgtgcttggcatatttttgcggaaactgacctctagagagacagctttaatggtcatcgggatggccatgaccactgtgctcagcattcctcacgacctgatggagttcatcgatggaatatcacttggcctgattctactcaagatggtaacacattttgacaacacccaggtgggtacactggcattggctctgactttcatcaaaagtaccatgccattagtcatggcctggaggacgatcatggcagttctctttgtggtgacactgattcccctttgtcgtacctcctgcctgcagaagcaatctcactgggtcgagatcactgccttgattctcggggctcaggcgctgcctgtgtacctaatgaccctgatgaaaggagccagcaagcgctcctggccccttaatgaaggcataatggcagttggcctcgtatcactgttggggagcgctctgttaaagaacgatgtgccactcgccggacctatggtcgccggtggcctgcttctggctgcatatgtgatgagtgggtcttccgccgacttgagcctcgagaaagcggctaatgttcagtgggatgaaatggccgacatcacaggatcgtcacccattatcgaggtgaagcaagatgaggacggctctttcagtattcgggatgtcgaagagactaacatgatcaccctgctagtgaaactggcacttataacggtatccggtctctacccactggccatcccggtcacaatgaccttgtggtacatgtggcaagtgaagactcagagaagcggggctttatgggacgttccttctcccgcagccgcgcagaaagctacactgaccgaaggagtgtataggattatgcaacgaggcctctttggcaagactcaggtcggggtgggaatccatacagagggtgttttccacaccatgtggcatgtgacgcggggcagcgtcatttgtcacgaatccgggcgcctggagccatcatgggccgatgtgagaaatgacatgatcagttacggaggcggttggaggcttggggataagtgggacaaagaggaagacgtacaggtgctggcaatagagcccggaaagaaccctaaacacgttcagactaagccaggcttgttcaaaaccctaacaggcgaaattggggccgtcaccctggattttaagcccggaacaagcggttctcctatcatcaatcggaaaggcaaggtgattgggctctatggaaacggcgtggtcactaagtccggtgactacgtatcagctataacccaagccgagcgaatcggggagccggattatgaagtggacgaggatattttcaggaagaagcgcctgacgatcatggaccttcatccaggagcaggcaaaacaaagaggattttacccagtatcgttcgtgaagctctgaaacggagactcaggactttgatactggcccctacccgcgtggtcgcggccgagatggaagaggcactccgaggcctgccaatcagataccagacacccgctgtaaagagcgagcacaccgggcgggaaattgttgatcttatgtgccatgccacttttaccacaaggctgttgtcctctacgcgcgtgcctaattataacctaatcgtcatggacgaggctcacttcactgatccgtcgagcgtggcagcccgtggatacatttcaaccagagtagaaatgggtgaggccgctgcggtgtttatgacagcaacacccccaggcactacagaccctttcccccagtccaatagtccaatcgaagatatagagcgggagattcctgaaaggtcttggaacaccgggtttgactggatcacggactaccagggaaagactgtttggttcgtccccagcatcaaagccggcaatgatattgctaactgcctgcgcaagtccggtaaaaaggtgatccaactctcacgaaaaacatttgacaccgagtatccaaagaccaagttaactgattgggacttcgtgataacaaccgatatttctgaaatgggggccaactttagagcaggccgggtcatcgacccgaggcgctgtctgaaacctgttattcttacagatggacccgagagagtgatcctggccggcccaatacccgtaactcctgctagcgcggcccagaggcgggggcgtattggacgcaatccagcacaggaagacgatcaatacgtgttcagtggtgaccccctccgaaacgatgaggaccacgctcattggacggaggccaagatgttgctggataatatctatacccctgaaggcatcattccgacactcttcgggccagagagagagaaaactcaggcaatcgacggagagtttaggctgcggggcgagcagcgcaagaccttcgtcgaacttatgagaaggggtgacctacccgtgtggctgtcccacaaagttgccagcgctgggatttcttacaaggatcgggagtggtgctttacaggcgaacgaaacaatcagatattggaggaaaacatggaggtggagatctggaccagagaaggagagaagaaaaagttacgccctaaatggctggacgccagggtctatgcggatcccatggcactcaaggacttcaaagaatttgcctcaggccggaagtccattactctggatatccttacggagatcgctagtctgccaacctacctcagctcgcgtgccaagttggctctggacaatattgtaatgctacatacaactgaaagagggggaaaagcatatcaacacgccctgaacgagctccctgagtctcttgaaaccctgatgttagtggctttgctgggtgccatgacagcaggcatattcctctttttcatgcaggggaagggaatgggcaaactgtccatgggtcttatcgcgattgccgttgctagcgggctgctctgggtggccgagatccagccccagtggattgcagcttcaatcatattggaatttttcctgatggtcctattagtgccagagcctgaaaagcaaaggaccccgcaggataatcagctgatctacgtcattctcactatccttacaattatcgccctggtggcagccaacgagatgggcttgatagagaaaacgaagaccgactttggattctaccaggttaaagctgaaactacaattctggatgtggacctccgccccgcgagtgcctggaccctgtatgcagtagctaccacaatccttactccaatgctccggcatacgattgagaatacctctgccaacctgtccttggccgcaatcgctaatcaagccgcggtgctgatgggcttagggaagggatggcctctacaccgaatggatctgggcgtccccctccttgctatgggttgttacagccaggttaacccaacaactctgaccgcctcattggtgatgctgctcgtccactatgcaataatcgggcctggactgcaggccaaggctacaagagaagcacagaaaaggaccgccgcgggcattatgaagaatcccactgtggacggtatcacggtaattgatcttgagccgatcagttacgacccaaaatttgagaagcaattaggccaggtgatgctgctcgttttgtgcgtggggcagctgctactgatgcgcacaacctgggctttctgtgaagtcctcactcttgccaccggacctatactgacattgtgggagggcaaccccgggcggttctggaacactaccattgcagtgagcacagccaatatctttagaggatcctatctggctggcgccggtctcgcattctctctgatcaaaaacgctcaaacgccacgtagggggaccggaactatgggcgaaacattaggtgagaagtggaagcggcagcttaatagcctggaccgcaaagaatttgaggagtacaagcgatccggcattctcgaagtcgatagaaccgaggccaggtcagcgctaaaagacgggtctaagatcaaatatgccgtgagtcggggaacttcgaagatacgctggattgttgaaagaggcatggtaaagcccaaagggaaggtggtcgatctgggatgcggcaggggtgggtggagctactacatggcaacattgaaaaacgtgaccgaggttaagggatatacgaaaggcggccctgggcatgaagaaccgatccccatggctacctacggatggaatctggtgaagctccactccggtgtcgacgtgttctataagccaacagagcaggtagatactcttctgtgtgacattggcgaatcttcaagcaaccctaccatcgaggaagggcgaacattgcgggtgctgaaaatggttgagccctggctctccagtaagcctgaattttgcataaaagtcttaaatccatacatgcccactgtgatcgaggagctggaaaaacttcagcgtagacatggaggctctctggtgcgctgtcctctaagcaggaactcaacccacgagatgtattgggtctccggtgttagtgggaatattgtgagctctgtaaacacaacctccaaaatgctcctgaatcggttcactacgagacaccgcaagccaacatacgaaaaagatgccgacttgggagcaggcaccaggtcagtgagcactgagaccgagaagcccgatatgacaatcattggccgacggctgcaaagactccaggaagaacataaggaaacgtggcactatgaccatgagaacccgtacaggacctgggcttaccacgggtcgtatgaagccccttctactggaagtgcctccagcatggtcaatggtgtggttaaacttctgacaaagccatgggatgtggtccccatggtgacccagttagcgatgactgacacaaccccttttggccagcaacgcgtattcaaagagaaggttgacacacgtactccacagcccaaaccggggacccaggtggtcatgacgaccacagctaactggctgtggactttgctcggacggaagaagaatcctagactgtgcaccagggaggaatttatctcaaaagtgcgctccaacgcagccattggcgctgtgttccaggaggaacaaggttggacatctgccagcgaggcagtcaatgatagtcgattttgggagttggttgacaaggagcgggcccttcatcaggaggggaaatgtgaatcctgcgtgtacaacatgatgggaaagagagagaaaaagctgggcgagttcggcagggctaaggggagccgcgcgatctggtatatgtggctcggagccagatttctggagttcgaagcattgggtttcctgaacgaggatcactggtttggccgggaaaattcttggtcaggggtagaaggagagggcctccacaggcttggttacatactggaagacattgataaaaaggacggggatttaatctatgctgacgatactgccggatgggacacccgtatcacggaggatgacctgttgaacgaggaactcattacagagcagatgacaccccatcacaaaatactggcaaaggccatcttcaaactaacttaccaaaataaggtggtcaaggtgcttcgaccaacacctaaaggcgctgttatggatattatcagtcgcaaggaccagagaggctccggacaggtgggaacctatggtctgaacacttttaccaatatggaagtccagctcattcggcaaatggaggccgaaggcgtgatcacaagggacgatatgcataaccccaaagggctgaaggagcgcgtagagaaatggttgaaggaatgcggagttgacagattaaaacggatggcgataagcggcgatgactgtgtggtcaagccactggatgagaggttctctacgtcgctcctttttctgaatgacatgggtaaggtgcgaaaagatatcccccagtgggaaccttcaaaggggtggaaaaactggcaggaggttccattctgcagccaccactttcataagattttcatgaaagacggacgttccctagtggtcccgtgtagaaatcaggatgaactgatcggccgcgcacggattagtcaaggcgccgggtggtctctcagggagaccgcttgcttgggaaaggcctacgcacagatgtggagcctgatgtactttcacagacgcgaccttcggctggcttccatggccatctgttcagctgtgcccactgagtggttccctacaagtaggaccacttggtctatacatgcccaccatcagtggatgacaaccgaagatatgctcaaggtatggaaccgagtgtggattgaggacaatccaaacatgatcgacaaaacgcccgtccacagctgggaagatatcccttatttaggtaagagagaggacctgtggtgcggctccttgattgggctgtcaagccgggcaacatgggcgaaaaatatacacaccgccatcactcaggttaggaacctcattggaaaggaagagtacgtggattatatgccagctatgcgccgttactctgcccattttgagtccgaaggcgtcctttga

SEQ ID NO: 15807 - RNA, 9867 nt, synthetic construct
  misc_feature 1..9867: note = derived and/or modified CDS sequence (opt3) from DENV-4__KT026309__SS-prME
  source 1..9867: mol_type = other RNA
agcaccatcactctgctctgccttattcccactgtgatggccttccacctgtccacgagagacggcgaacctttgatgatagtcgctaagcatgaaagagggcggccattactgtttaaaaccactgaggggatcaacaagtgtactctaattgcaatggatctcggtgaaatgtgcgaggacaccgttacctacaaatgtccgctgcttgtgaataccgaacccgaggatatcgactgctggtgtaacctgacttctacctgggtgatgtatggaacctgcacgcagtcaggggagcgccgacgtgaaaagagaagtgtggccttgactcctcacagcggaatgggcctcgagaccagagcggaaacatggatgtcctctgagggtgcttggaaacatgcccagcgggtcgagtcgtggattctgcgcaatccagggttcgcactgctcgccggatttatggcttacatgatcggccagactggcattcagagaaccgtgttctttatcttaatgatgctggttgcaccctcatatgggatgaggtgtgtgggagtcggtaaccgggatttcgtggaaggcgtaagcgggggagcctgggttgaccttgtgttggagcacggcggttgcgtcacaaccatggctcaggggaagcctacgctggattttgaactaattaagactacagccaaagaggtggcgctcctgcgcacctactgtatcgaagcaagtatttccaatatcactacagccacccgatgcccaacgcaaggagagccctatcttaaggaggaacaggaccagcagtacatatgtagaagggatatggtggaccggggctggggcaacgggtgcggactgttcggtaaaggcggggtcgttacctgcgctaagttttcttgtttgggaaaaattacaggcaatctcgtgcaaatcgagaacctggaatatactgtagtggtcaccgtgcataatggtgatacacacgccgttgggaacgacactagcaatcacggcgtgaccgcaacaattacccctcgttccccatcagtcgaggtgcagttaccggattacggagaactgactctcgactgcgagccccgcagtggcatcgacttcaacgagatgatccttatgaagatgaagacgaaaacatggctggtacataagcagtggtttttggatctacctctgccatggaccactggggctgacaccctcgaagttcactggaatcataaagagagaatggtgacattcaaggtcccccacgccaaaaggcaggatgtgaccgtcctgggaagccaagaaggtgcgatgcactctgcccttgcaggcgctactgaggtggactccggggatggaaaccatatgtttgccggccacctgaagtgtaaagttcggatggaaaagttgcgaattaagggtatgtcatacacaatgtgcagcgggaaattcagtatagacaaggagatggctgagacgcagcatggcaccactgtggtaaaagtcaagtatgaaggaacaggcgccccttgtaaagtgccaatcgagattcgcgatgttaataaggaaaaggtggtcgggagaatcatatcttccacccccttcgcagagaacacaaacagcgtgactaatattgagctcgaaccgccttttggagactcgtacatcgtaatcggtgtgggcgattctgccctgaccttacactggttcaggaaagggtcctcaattggaaagatgtttgagagtacgtatcggggcgctaaacgcatggcgatcctgggtgaaaccgcatgggacttcgggagcgttggcggactactcacatccctgggcaaggccgtccatcaggtgtttgggtctgtgtacactaccatgttcggaggcgtcagctggatggttaggattcttataggtttgctggtgctctggatcgggacaaactcaaggaatacaagtatggctatgtcctgcattgccgtgggaggcatcaccctgtttcttggtttcacggtacacgcagatatgggctgtgtcgtgagctggtctgggaaagagctgaagtgcggatcaggcatctttgttattgacaacgtgcacacatggaccgaacaatataagttccagcccgagagtccagcccgtttggctagcgccatactcaatgcacataaagagggggtctgtggaatccggtccactacacgactggaaaacgtgatgtggaagcagattaccaatgagttaaactacgttctgtgggaaggcggtcacgacctaactgtggtagcgggggatgtcaaaggagtgctctctaagggcaaaagagctctggcccctcccgtgaatgaccttaagtattcgtggaagacctggggtaaagcaaagatctttacaccagagacgaggaacagcaccttcttggtcgatggccccgacacttccgaatgccctaatgagcgccgggcctggaactttctggaggttgaagattacgggttcggaatgttcacaaccaatatttggatgaaatttagagagggctcaagtgaagtgtgtgaccataggctcatgtctgctgccatcaaggatcagaaagcagtacacgctgacatggggtactggatagagagctccaagaaccaaacatggcagatcgaaaaagcctcactgattgaggtgaagacttgcttatggccaaagacccacacgctgtggagcaatggagtccttgagtctcagatgttgatcccgaaagcgtatgccggccccatttcccagcataactaccgccaaggttatgctacacagaccgcagggccttggcacctcggaaagctggaaatcgatttcggcgagtgcccaggtactaccgtgacagttcaggaagactgtgatcatcgaggccccagtctacggactaccacagccagcgggaaactggtgacgcagtggtgctgtcgttcttgcaccatgcctccactcagatttctgggagaggacggctgttggtacgggatggagataaggccccttaacgaaaaggaggaaaatatggtcaaatcccaagtgtcagctggacacggcacaagtgagacattcagcatgggtttgctgtgcttaaccctctttgttgaagagtgtctgcgccggagagtgactaggaagcatatgattcttgtcgtagtgacaaccctgtgcgccatcattctaggcgggctcacgtggatggatctgctacgagcactgatcatgctcggggacactatgtcgggccgcatgggaggccagatacacctggcgatcatggccgttttcaagatgtccccgggttatgtgcttggcatatttttgcggaaactgacctctagagagacagctttaatggtcatcgggatggccatgaccactgtgctcagcattcctcacgacctgatggagttcatcgatggaatatcacttggcctgattctactcaagatggtaacacattttgacaacacccaggtgggtacactggcattggctctgactttcatcaaaagtaccatgccattagtcatggcctggaggacgatcatggcagttctctttgtggtgacactgattcccctttgtcgtacctcctgcctgcagaagcaatctcactgggtcgagatcactgccttgattctcggggctcaggcgctgcctgtgtacctaatgaccctgatgaaaggagccagcaagcgctcctggccccttaatgaaggcataatggcagttggcctcgtatcactgttggggagcgctctgttaaagaacgatgtgccactcgccggacctatggtcgccggtggcctgcttctggctgcatatgtgatgagtgggtcttccgccgacttgagcctcgagaaagcggctaatgttcagtgggatgaaatggccgacatcacaggatcgtcacccattatcgaggtgaagcaagatgaggacggctctttcagtattcgggatgtcgaagagactaacatgatcaccctgctagtgaaactggcacttataacggtatccggtctctacccactggccatcccggtcacaatgaccttgtggtacatgtggcaagtgaagactcagagaagcggggctttatgggacgttccttctcccgcagccgcgcagaaagctacactgaccgaaggagtgtataggattatgcaacgaggcctctttggcaagactcaggtcggggtgggaatccatacagagggtgttttccacaccatgtggcatgtgacgcggggcagcgtcatttgtcacgaatccgggcgcctggagccatcatgggccgatgtgagaaatgacatgatcagttacggaggcggttggaggcttggggataagtgggacaaagaggaagacgtacaggtgctggcaatagagcccggaaagaaccctaaacacgttcagactaagccaggcttgttcaaaaccctaacaggcgaaattggggccgtcaccctggattttaagcccggaacaagcggttctcctatcatcaatcggaaaggcaaggtgattgggctctatggaaacggcgtggtcactaagtccggtgactacgtatcagctataacccaagccgagcgaatcggggagccggattatgaagtggacgaggatattttcaggaagaagcgcctgacgatcatggaccttcatccaggagcaggcaaaacaaagaggattttacccagtatcgttcgtgaagctctgaaacggagactcaggactttgatactggcccctacccgcgtggtcgcggccgagatggaagaggcactccgaggcctgccaatcagataccagacacccgctgtaaagagcgagcacaccgggcgggaaattgttgatcttatgtgccatgccacttttaccacaaggctgttgtcctctacgcgcgtgcctaattataacctaatcgtcatggacgaggctcacttcactgatccgtcgagcgtggcagcccgtggatacatttcaaccagagtagaaatgggtgaggccgctgcggtgtttatgacagcaacacccccaggcactacagaccctttcccccagtccaatagtccaatcgaagatatagagcgggagattcctgaaaggtcttggaacaccgggtttgactggatcacggactaccagggaaagactgtttggttcgtccccagcatcaaagccggcaatgatattgctaactgcctgcgcaagtccggtaaaaaggtgatccaactctcacgaaaaacatttgacaccgagtatccaaagaccaagttaactgattgggacttcgtgataacaaccgatatttctgaaatgggggccaactttagagcaggccgggtcatcgacccgaggcgctgtctgaaacctgttattcttacagatggacccgagagagtgatcctggccggcccaatacccgtaactcctgctagcgcggcccagaggcgggggcgtattggacgcaatccagcacaggaagacgatcaatacgtgttcagtggtgaccccctccgaaacgatgaggaccacgctcattggacggaggccaagatgttgctggataatatctatacccctgaaggcatcattccgacactcttcgggccagagagagagaaaactcaggcaatcgacggagagtttaggctgcggggcgagcagcgcaagaccttcgtcgaacttatgagaaggggtgacctacccgtgtggctgtcccacaaagttgccagcgctgggatttcttacaaggatcgggagtggtgctttacaggcgaacgaaacaatcagatattggaggaaaacatcgaggtggagatttggaccagagaaggagagaagaaaaagttacgccctaaatggctggacgccagggtctatgcggatcccatggcactcaaggacttcaaagaatttgcctcaggccggaagtccatcactctggatatccttacggagattgctagtctgccaacctacctcagctcgcgtgccaagttggctctggacaatatagtaatgctacatacaactgaaagagggggaaaagcatatcaacacgccctgaacgagctccctgagtctcttgaaaccctgatgttagtggctttgctgggtgccatgacagcaggcatcttcctctttttcatgcaggggaagggaatgggcaaactgtccatgggtcttattgcgatcgccgttgctagcgggctgctctgggtggccgagattcagccccagtggatcgcagcttcaataatcttggaatttttcctgatggtcctattagtgccagagcctgaaaagcaaaggaccccgcaggataatcagctgatttacgtcatcctcactattcttacaatcatagccctggtggcagccaacgagatgggcttgattgagaaaacgaagaccgactttggattctaccaggttaaagctgaaactacaatcctggatgtggacctccgccccgcgagtgcctggaccctgtatgcagtagctaccacaattcttactccaatgctccggcatacgatcgagaatacctctgccaacctgtccttggccgcaatagctaatcaagccgcggtgctgatgggcttagggaagggatggcctctacaccgaatggatctgggcgtccccctccttgctatgggttgttacagccaggttaacccaacaactctgaccgcctcattggtgatgctgctcgtccactatgcaatcattgggcctggactgcaggccaaggctacaagagaagcacagaaaaggaccgccgcgggcatcatgaagaatcccactgtggacggtattacggtaatcgatcttgagccgataagttacgacccaaaatttgagaagcaattaggccaggtgatgctgctcgttttgtgcgtggggcagctgctactgatgcgcacaacctgggctttctgtgaagtcctcactcttgccaccggacctattctgacattgtgggagggcaaccccgggcggttctggaacactaccatcgcagtgagcacagccaatatctttagaggatcctatctggctggcgccggtctcgcattctctctgattaaaaacgctcaaacgccacgtagggggaccggaactatgggcgaaacattaggtgagaagtggaagcggcagcttaatagcctggaccgcaaagaatttgaggagtacaagcgatccggcatcctcgaagtcgatagaaccgaggccaggtcagcgctaaaagacgggtctaagataaaatatgccgtgagtcggggaacttcgaagattcgctggatcgttgaaagaggcatggtaaagcccaaagggaaggtggtcgatctgggatgcggcaggggtgggtggagctactacatggcaacattgaaaaacgtgaccgaggttaagggatatacgaaaggcggccctgggcatgaagaaccgattcccatggctacctacggatggaatctggtgaagctccactccggtgtcgacgtgttctataagccaacagagcaggtagatactcttctgtgtgacatcggcgaatcttcaagcaaccctaccatagaggaagggcgaacattgcgggtgctgaaaatggttgagccctggctctccagtaagcctgaattttgcatcaaagtcttaaatccatacatgcccactgtgattgaggagctggaaaaacttcagcgtagacatggaggctctctggtgcgctgtcctctaagcaggaactcaacccacgagatgtattgggtctccggtgttagtgggaatatcgtgagctctgtaaacacaacctccaaaatgctcctgaatcggttcactacgagacaccgcaagccaacatacgaaaaagatgccgacttgggagcaggcaccaggtcagtgagcactgagaccgagaagcccgatatgacaattatcggccgacggctgcaaagactccaggaagaacataaggaaacgtggcactatgaccatgagaacccgtacaggacctgggcttaccacgggtcgtatgaagccccttctactggaagtgcctccagcatggtcaatggtgtggttaaacttctgacaaagccatgggatgtggtccccatggtgacccagttagcgatgactgacacaaccccttttggccagcaacgcgtattcaaagagaaggttgacacacgtactccacagcccaaaccggggacccaggtggtcatgacgaccacagctaactggctgtggactttgctcggacggaagaagaatcctagactgtgcaccagggaggaatttatttcaaaagtgcgctccaacgcagccatcggcgctgtgttccaggaggaacaaggttggacatctgccagcgaggcagtcaatgatagtcgattttgggagttggttgacaaggagcgggcccttcatcaggaggggaaatgtgaatcctgcgtgtacaacatgatgggaaagagagagaaaaagctgggcgagttcggcagggctaaggggagccgcgcgatatggtatatgtggctcggagccagatttctggagttcgaagcattgggtttcctgaacgaggatcactggtttggccgggaaaattcttggtcaggggtagaaggagagggcctccacaggcttggttacattctggaagacatcgataaaaaggacggggatttaatctatgctgacgatactgccggatgggacacccgtattacggaggatgacctgttgaacgaggaactcataacagagcagatgacaccccatcacaaaatcctggcaaaggccattttcaaactaacttaccaaaataaggtggtcaaggtgcttcgaccaacacctaaaggcgctgttatggatatcattagtcgcaaggaccagagaggctccggacaggtgggaacctatggtctgaacacttttaccaatatggaagtccagctcatccggcaaatggaggccgaaggcgtgataacaagggacgatatgcataaccccaaagggctgaaggagcgcgtagagaaatggttgaaggaatgcggagttgacagattaaaacggatggcgatcagcggcgatgactgtgtggtcaagccactggatgagaggttctctacgtcgctcctttttctgaatgacatgggtaaggtgcgaaaagatattccccagtgggaaccttcaaaggggtggaaaaactggcaggaggttccattctgcagccaccactttcataagatcttcatgaaagacggacgttccctagtggtcccgtgtagaaatcaggatgaactgattggccgcgcacggatcagtcaaggcgccgggtggtctctcagggagaccgcttgcttgggaaaggcctacgcacagatgtggagcctgatgtactttcacagacgcgaccttcggctggcttccatggccatatgttcagctgtgcccactgagtggttccctacaagtaggaccacttggtctattcatgcccaccatcagtggatgacaaccgaagatatgctcaaggtatggaaccgagtgtggatcgaggacaatccaaacatgatcgacaaaacgcccgtccacagctgggaagatattccttatttaggtaagagagaggacctgtggtgcggctccttgatagggctgtcaagccgggcaacatgggcgaaaaatatccacaccgccattactcaggttaggaacctcatcggaaaggaagagtacgtggattatatgccagctatgcgccgttactctgcccattttgagtccgaaggcgtcctttga

SEQ ID NO: 15808 - RNA, 9867 nt, synthetic construct
  misc_feature 1..9867: note = derived and/or modified CDS sequence (opt3) from DENV-4__KF907503__SS-prME
  source 1..9867: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatggcacctgcacgcagtcaggggagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaatgattacccctcgttcaccaagtgtagaggttaagctgccggattacggagaattaactctggactgcgagccccgcagcggcatcgacttcaacgagatgattctcatgaagatgaaaaagaaaacgtggcttgtgcataagcagtggtttctggatttgcctctaccatggacagctggggccgacacctctgaagtccactggaattacaaagagagaatggtgactttcaaggtcccccatgcgaaaaggcaggatgtgaccgttctgggatcccaggaaggtgccatgcactcagcactcgctggcgccacagaggtggacagcggggatggaaaccacatgtttgctggccatctgaagtgtaaggtacggatggaaaaacttcgaatcaagggtatgagttataccatgtgctctgggaaattctccatcgacaaggagatggccgagactcaacacggcacaacggtcgtgaaagttaagtacgaaggagcaggcgccccttgtaaggtgccaattgagatacgcgatgtcaataaagaaaaggtggtagggagaatcattagctcgacccccctggctgagaacactaactctgtgacaaatatcgagttggaaccgcctttcggagactcctatatagttattggtgtcggcaactcagcgctcaccctgcattggtttaggaaagggagtagcatcggaaagatgttcgagtccacataccggggcgcaaaacgcatggccatcttaggtgaaactgcttgggattttgggtctgtgggcggactgttcaccagcctaggcaaggccgtgcaccaggtctttgggtcagtttatacgaccatgttcggaggcgtgagttggatgattagaatcctcattggttttctggtgctttggatagggacaaattccaggaacactagcatggcaatgacctgcatcgccgtaggaggcattacattgttcctgggttttactgtccaggctgacatgggctgtgtggtttcttggtcagggaaggagctcaaatgcggaagtggcatcttcgtggtcgataatgtgcatacctggacggaacaatacaagtttcagcccgagagcccagcccgtctggcatccgcgatccttaacgctcacaaagacggggtttgtggaattcggtctacaacccgactggagaatgtgatgtggaagcagataactaacgaattgaattatgtactctgggagggcggtcacgacctgacagtcgtggccggggatgtgaaaggagtcttaaccaagggcaagagagcactgactcctcccgtttcggacctaaaatacagctggaagacctggggtaaagccaagatcttcacaccagaagctaggaactccacgtttctcattgatggccccgacacctcagagtgccctaatgaacgccgggcctggaacagtctggaggtggaggattacgggttcggaatgttcactacaaatatctggatgaaatttagagaaggctctagcgaggtatgtgaccataggcttatgtccgcagctattaaggatcagaaagccgtgcacgcggacatggggtattggatcgaatcaagcaagaaccaaacctggcagatagagaaggcctctttgatcgaagtcaaaacatgcctgtggccaaagactcataccctctggtccaatggagtgctggagagtcagatgttaattccgaaaagctacgctggccccttctctcagcacaactatcgccaaggttacgcaacgcagacagttgggccttggcacctgggaaagcttgagatcgattttggcgaatgcccaggtaccactgtgaccattcaggaggactgtgatcatcgaggcccctccttgcggacatcaactgccagtgggaaactcgtcacccagtggtgctgtcgtagctgcacaatgcctccactgagattcctaggagaagacggctgttggtatgggatggagatcaggcccctgtcggagaaggaagagaacatggtgaagtcccaagttacggctggacagggcacctctgaaacttttagcatgggtctcctgtgccttacattgttcgtggaggaatgtctgcgccggagagtcaccaggaaacacatgatattagtagtggttattactctctgcgccatcattctggggggacttacatggatggatctgttgcgagcactcatcatgctgggcgacaccatgtcaggccgcatagggggacagatccatctagcgattatggccgtgtttaagatgagtccgggttacgtcctgggcgtgttcctccggaaactgacgtccagagagactgctcttatggtaatcgggatggccatgaccacagtgttgtctattcctcacgacctgatggagttaatcgatggaataagcctcggcctgattcttctgaagatcgtcacccagtttgacaatactcaagttggtacactagcactctccctgaccttcatcaggtcaacaatgccattgattatggcttggcgtactatcatggccgtgctgtttgtggtcaccttaattcccctctgtcgcacgagctgcctgcagaaacagagtcattgggtggaaataacagcacttatcctgggggcccaagctttgcctgtttatctcatgaccctgatgaagggagcgtctcggagatcctggcccctaaacgagggcattatggccgtaggcctggtgagccttctcgggtcggcactgttgaagaatgatgtcccactggctggacctatggtggccggtggcttactcctggccgcttacgttatgtcagggtctagtgcagacctttccctggaaaaagccgcgaacgtgcagtgggatgagatggctgacatcactggaagctctcccattatcgaagtcaagcaggatgaggacggcagcttctccataagggatgtggaggaaaccaatatgatcacattgctcgtaaaactggccctaattactgtctcaggtctgtacccacttgcaatcccggtgaccatgacgctctggtatatgtggcaggttaagacacaacgaagtggggccctgtgggacgtgcctagccccgctgcaacccagaaagccgcgttgtctgagggagtctaccggattatgcagcgcggcttatttggcaagactcaggtgggggttggaatccacatggaaggtgtgttccacacaatgtggcatgtcaccagaggctccgtgatatgtcacgagactgggaggctggaaccatcatgggctgatgtacggaacgacatgattagttatggaggcggttggcgactcggggataagtgggacaaagaggaggacgtgcaagttctggccatcgaacccggaaagaatcctaaacatgtccagacaaagccaggccttttcaaaaccctgacgggcgagatcggggcagtgactttggattttaagcccggaaccagcggttcccctattataaacagaaaaggcaaggtgatcgggctatacggaaatggcgtcgtaacaaagtctggtgactatgtgtcggccattacccaggctgaacgcatcggggagccggattacgaggttgacgaagatattttcaggaaaaagcgtctgacaatcatggacctccacccaggagccggcaaaactaagcggatactgcccagcatcgtgagagaggcacttaaaaggcgcttacgaaccctgattctcgctcctacgagagtcgtggccgcggaaatggaggaagccttgcggggcctgccaatcaggtatcagacacccgcagttaagtcagagcatactgggcgcgagattgtggatctcatgtgccacgctacctccacaacccgtctgcttagttctactagagtccctaactacaatctgatcgtgatggacgaagcccactttaccgatccgagctccgtagctgcacggggatacatatcaacaagggtggagatgggtgaagccgccgctattttcatgacggcgactcccccaggcgcaaccgacccttttccccaatctaacagcccaatcgaggatatcgaacgcgagattcctgagcgaagttggaatacagggttcgactggatcaccgactatcagggaaagactgtttggtttgtcccctccataaaagccggcaacgatattgctaattgcttgagaaagagcggtaaaaaggtgatccagctatctcggaaaacattcgacaccgaatacccaaagacgaagctgactgattgggactttgtggtcacaaccgatatttcagagatgggggccaacttcagggcaggccgcgttatcgacccgagaaggtgtctcaaacctgtgatattaaccgatggacccgaacgggtaattctggccggcccaatccccgtgactcctgcttccgcggcccaacgtcgcgggcgaatcggaagaaacccagcacaggaggacgatcagtatgtctttagtggtgacccccttaagaatgatgaagaccatgctcactggacagaggccaaaatgctgctcgataacatttacacccctgagggcatcattccgacattgttcgggccagaaagggagaagactcaggcaatagacggagaattccggctgcgcggcgagcaaagaaaaacgtttgtggagctcatgaggcggggtgacctgcccgtttggcttagctataaggtggcctcggctgggatctcttacaaggatcgagaatggtgcttcaccggcgagagaaataaccagattctagaagagaatatggaagtcgagatctggacacgcgagggagaaaaaaagaaactgaggcctcggtggttggacgcccgtgtatatgcggatcccatggcattaaaggactttaaagagttcgcctccggcagaaagagcatcactctggatattctcaccgaaatagcttcactgccaacataccttagttctagggccaagctggctctcgacaacatcgtgatgttgcataccactgagcgcgggggacgggcataccagcacgccctgaatgaactacctgagtccctggagacgctcatgcttgttgctctgttaggtgccatgaccgcaggcatttttttgttctttatgcaggggaaaggaatcggcaagctgagcatgggtctcattatcatagcggtggcctcagggctgctttgggtcgctgaaatccaaccccagtggattgccgcaagtatcattctggagttctttctcatggtgttgctgatcccagaacctgagaaacagcgaacaccgcaggataaccaattaatatatgtcattctaactatcctgaccattatcggcctcatagctgccaatgaaatgggacttatcgagaagacaaaaaccgacttcggcttttaccaggtgaagactgagacaacgattctggatgttgacttgagacccgcaagcgcctggaccctgtatgctgtggcgactacaatcctcaccccaatgctgaggcacaccattgaaaacacatccgccaatctttctctcgcagctatcgccaaccaggccgcagtactgatggggttgggaaaaggctggcctctgcatcgcatggatttaggtgtgcccctactggctatggggtgttacagccaggtcaatccaactacgctcaccgcctcccttgttatgctgtcagtgcactatgcgataattggacctggcttgcaagctaaggccacacgggaggcacagaagagaactgccgctggtatcatgaaaaaccccaccgtcgacggcatcacagtgattgatctggaaccgatctcttacgacccaaagttcgagaaacagctcgggcaagtaatgctgcttgtgttatgcgcaggacagctgctcttgatgcgtaccacttgggccttttgtgaggttctgacgctagcgacaggccctatactgaccctctgggaagggaatcccggaaggttctggaacactaccattgctgtgagtacagccaacatcttccggggctcgtatcttgcaggtgccgggctggcttttagcttgattaagaatgcccagactccacgccgaggaaccggcacaacgggtgagaccctgggcgaaaaatggaagagacagctcaactccctggacaggaaggagttcgaagagtacaaacggtctgggatcttagaggtcgatcgcactgaagcaaagtcagctcttaaagacggaagcaagataaaacatgccgtgtccagaggcagttctaagatcaggtggattgtcgagcgagggatggtgaagcccaaaggaaaggttgtagatctgggctgcggtcgggggggatggagctactatatggcgacactcaaaaatgtgaccgaagtcaagggctacactaaaggcgggcctggacacgaggaaccgatccccatggccacatatggttggaacctagtgaagctgcattcaggcgttgacgtgttttacaagccaaccgagcaagtcgatacgttgctgtgtgacattggggagtccagtagcaatcctaccatcgaagagggacgtacactcagagtgcttaaaatggtagaaccctggctgtcttccaagcctgagttctgcattaaagtgttgaacccatatatgcccactgttatcgaagagctggagaagctccagcgcaaacacggcggtaatttagtcaggtgtcctctgtcacggaacagcacccacgaaatgtactgggtgtcgggggcatctggaaatatagtgagttccgtcaacacaactagcaagatgcttctgaatagatttaccacacgccataggaaaccaacctatgagaaggatgttgacctaggcgctggcactcgatcagtgtccacggaaacagagaagcccgatatgaccattatcgggcggagactccagaggctgcaggaggaacacaaagagacttggcattacgaccaagaaaacccgtaccgcacctgggcctatcacggatcttacgaggcacctagcacaggtagtgcttccagcatggtaaatggcgtggtcaagttgctgacgaaaccatgggatgtgatccccatggttacccagctcgccatgactgacacaacccctttcgggcagcagcgtgtgtttaaggaaaaagtcgacactcggacaccacaacccaagccgggaaccagaatggtgatgacaactaccgccaactggctttgggcgctgttaggcaagaaaaagaatcctaggctgtgcacgcgcgaggagttcatttctaaagtacgatcaaacgctgcaataggtgccgtttttcaggaagagcaggggtggaccagtgcttccgaagccgtgaatgatagccggttctgggagttggtcgacaaggaaagagcactccaccaagagggaaaatgtgagtcttgcgtgtataacatgatgggcaagagggaaaagaaactgggcgagtttgggcgcgccaagggatcgagagctatctggtacatgtggctaggtgcgcggttccttgaatttgaggccctgggcttcctcaacgaagatcattggttcgggagggagaattcatggagcggagtggagggcgaaggtctgcaccgtttggggtatattctggaggaaatcgacaaaaaggatggagacctcatgtacgcagatgacacagctggctgggatactcgaattaccgaggacgatcttcagaacgaggaactgatcacagagcagatggccccccatcacaaaatattagcaaaggccatctttaagctgacttatcagaataaagtcgttaaggtgttgcgcccaacccctagaggcgctgtaatggacattatctcccggaaagatcaaagggggagtggacaggtgggtacgtacggcctcaacacattcaccaatatggaagtccagctgattcgccagatggaggccgaaggggtgatcactcaagacgacatgcagaaccccaagggactaaaagagagagttgagaagtggcttaaagaatgcggcgtggatcggctgaagaggatggcgatatctggtgacgattgtgtcgtgaagccactcgacgagcgatttgggacaagcctgttgttcttaaatgatatgggaaaagtacgtaaggacattccccagtgggaaccttccaaaggctggaagaactggcaggaggttccattttgctcacatcacttccacaaaatctttatgaaggatggcagaagtctggtggtcccgtgtcgcaatcaagacgaactcatcgggcgggcaaggatttctcagggagccggttggagccttagagagaccgcttgcctgggcaaggcctacgcacagatgtggtccctaatgtatttccatcgccgggatctgaggctcgcttcaatggccatatgtagcgctgtgcccactgagtggtttcctacctctcgaacaacgtggtccatccacgcccatcaccagtggatgaccactgaagacatgttgaaagtttggaacagagtgtggattgaggataatccaaacatgacagacaagacccccgtccacagttgggaagacatcccttacctggggaaacgggaggatctttggtgcggaagcctgattggcctctcgtccagggcaacttgggcgaagaatatccatacagccataacccaagtgcgcaacttaatcggtaaagaagagtatgtagactacatgccagtgatgaagcgttattctgctccctcagagagcgaaggggtcctgtga

SEQ ID NO: 15809 - RNA, 9867 nt, synthetic construct
  misc_feature 1..9867: note = derived and/or modified CDS sequence (opt3) from DENV-4__AY947539__SS-prME
  source 1..9867: mol_type = other RNA
agcaccatgacactgctctgccttatccccactgccatggctttccacctgtccacgagagacggcgagcctttgatgattgtggcaaggcatgaacgggggcgcccattactgtttaagaccacagagggaataaacaaatgtactctaatcgccatggatctcggtgaaatgtgcgaggacaccgtcacatacgaatgtccgctgcttgttaataccgagcccgaggatattgactgctggtgtaacctgacttctgcgtgggtgatgtatggcacatgcacccagtcaggggaacgacgtagagagaagaggagtgtagctttgacgcctcacagcggaatgggcctcgaaactcgggccgagacctggatgtcctctgagggtgcatggaaacatgcccaacgcgtggaatcgtggatcctgagaaatccagggttcgctctgctcgcaggatttatggcctacatgattggccagacaggcatccagaggactgtcttctttgtgttaatgatgctggttgctccctcatatgggatgcggtgtgtgggagtcggtaaccgcgatttcgtggagggcgtaagcgggggagcctgggttgaccttgtgttggaacacggcggttgcgtcaccacaatggcgcaggggaagcctaccctggattttgagctaataaaaacgactgcaaaggaagtggccctcctgcgaacatactgtatcgaggctagtatttccaatatcaccactgccacaagatgcccaacccaaggagagccctatcttaaggaagagcaggaccagcagtacatttgtaggcgggatgtggtcgaccgtggctggggcaacgggtgcggactgttcggtaaaggcggggttgtgacgtgcgcaaagttttcttgtagcggaaaaatcaccggcaatttggtacaaatagaaaacctcgagtatacagtggtcgtgactgttcataatggtgatacccacgctgtggggaacgacattcctaatcacggcgtcacagccactatcaccccacgctccccgtcagtggaagtaaagctgcccgattacggagagttaacactggactgcgagcctagaagtggcattgacttcaacgaaatgatcctcatgaaaatgaagaagaaaacctggcttgttcataagcagtggtttctggatttgccactaccctgggcggccggggcagacactagcgaggtgcactggaattacaaagaaaggatggtcacgttcaaggtgcctcatgctaaacggcaggatgtcacagtgctgggatctcaggagggtgccatgcactccgctctcaccggcgccactgaagttgactcaggggatggaaaccacatgtttgcaggccatctgaagtgtaaagtgcgaatggagaagcttcgcatcaagggtatgagctataccatgtgcagtgggaaattctctattgacaaggagatggccgaaacacaacacggcaccactgtagtcaaagtgaagtacgagggagctggcgcgccatgtaaagttcccatagaaatcagagatgtgaataaggagaaggtcgtggggaggattatctccagcacaccgttcgcagagtatacgaactcggtaaccaacatagaactggagcctccctttggagactcttacattgtgatcggtgttggcgattccgccttgactctccattggttccggaaagggtcaagtatcggaaagatgctggaaagcacatatcgcggcgctaaaagaatggccattttaggtgagaccgcatgggactttgggtccgtcggcggactgctaacatctctcggcaaggccgtgcaccaggtgttcgggagcgtctacactaccatgtttggaggcgtttcatggatggtgaggatcctgattggtttccttgtgttgtggatagggacgaatagtcgtaacacctccatggctatgacatgcatcgccgtaggaggcattactctgtttctcggtttcaccgtccatgcagatacaggctgtgcggtgagctggtctgggaaagaactgaagtgcggatcaggcatctttgttatcgacaatgtgcacacttggaccgagcagtataagttccaaccagagagtcctgctcggcttgccagcgcaattctgaacgcccacgaagacggggtctgtggaatacgatccacgacaagattggagaatatcatgtggaaacagattaccaacgaactcaattacgtgctgtgggagggcggtcatgatttaactgttgtggctggggacgtaaagggagtcctgtctaaaggcaagagggccctagcacccccagtgaacgatctcaaatactcgtggaagacatggggtaaggctaaaatctttacccccgaagccaagaatagcactttcctgattgacggccctgatacctccgagtgcccaaacgagcgccgggcgtggaattttcttgaagtggaggactatgggttcggaatgttcacaacgaacatctggatgaaatttagagaaggctcaagtgaggtctgtgatcacaggttgatgtctgccgctataaaggaccagaaagcagttcatgccgatatggggtactggatcgaaagctccaagaatcagacctggcaaattgagaaagcttcactgatcgaggtgaagacttgcctctggccgaagacacacaccctgtggagcaacggagtattagaatctcagatgctgattcccaaagcctatgcaggccctttctcccagcacaattaccgccagggttatgcgacacaaactgtggggccatggcatcttggaaagttggagatcgactttggcgaatgccccggtaccacggtcacaatacaggaggattgtgaccaccgaggccctagtctccggaccactaccgccagcgggaaactggtgacacagtggtgctgtcgttcttgcactatgccacccctaagattcctgggagaggatggctgttggtacgggatggaaattaggccgctctccgagaaggaagagaacatggttaaatcacaggtgagtgctggacaaggcaccagcgaaacattttcgatgggtctgctttgcttgacgctgttcgtcgaggagtgtttacgccggagagtgaccaggaagcatatgatcctcgttgtggtcactacactgtgcgccattatccttgggggactgacctggatggacttgctccgagcactgataatgctaggcgacactatgtccggccgcatggggggacagatccacctggctattatggccgtatttaagatgtctcctggttatgtgctcggcatcttcctgcggaaacttacaagcagagaaaccgcattgatggttattgggatggccatgacgactgtgctgtcaatcccacatgatttaatggagtttatagacggaattagtctcggcctgatccttctgaagatggtcacccacttcgataacacacaggtgggtaccctagctctctccctgacttttatcaggtctacaatgcccttggtaatggcgtggcgtaccattatggccgtgctgttcgtcgttacattaatccctctctgtcgcactagctgcctgcagaaacaatcccactgggtggaaattaccgcacttatactgggggctcaggccttgcccgtgtacctcatgacgctgatgaagggagcctcaaaacggagctggccactaaatgagggcatcatggctgtcggcctggtgagtcttctcgggtctgcactgttgaagaacgacgttcctctggccggacccatggtagcgggtggcttactcctggctgcctacgtgatgtccgggagctcggcagatctttcactggaaaaggccgctaatgtccagtgggacgagatggcagatattacaggatctagtccaatcattgaggtgaaacaagacgaagatggctcctttagcatcagagacatagaggaaaccaacatgatcactttgctcgttaagctggccctaattaccgtgtctggtctgtatccgcttgcgatccctgtcacaatgactctctggtacatgtggcaggtgaaaacccagaggagcggggctctgtgggatgtaccctccccagccgcagcccagaaggctacgttgacagagggagtctatcgaattatgcaacggggcttattcggcaaaacccaggtgggggttggaatccatatggaaggtgtgttccacactatgtggcatgtcacacgcggctcagtgatatgtcacgagaccgggagactggagcccagttgggccgacgttaggaatgatatgattagctacggaggcggttggcggctcggggacaagtgggacaaggaagaggatgtgcaggtcctggcaatcgaacctggaaaaaacccaaagcatgtgcagactaaacccggcctttttaagacactgaccggcgagatcggggctgtaacgttggacttcaaacctggaacttctggttccccgattataaatcgaaagggcaaagtgatcgggctatatggaaacggcgttgtcaccaagtcaggtgattacgtgagtgccattacacaagcggagagaaccggggaaccagactatgaggtggatgaagacatctttcgcaagaaaaggctgacaattatggatctccaccccggagccggcaagactaaacgtatcctgcctagcatagtccgggaggcacttaagagaaggttacgcaccctgatcctcgctccaacgcgagtagtggccgctgaaatggaggaggcattgagaggcctgcccattcggtaccagacacctgccgttaaatccgaacacactgggagggagatcgtggacctcatgtgccatgccaccttcacaacccgcctgctttcttcgactcgtgtcccgaattacaacctgattgtgatggatgaagctcactttaccgaccccagctcagttgcggcaagaggatatatctccacacgggtggagatgggtgaagccgctgccatattcatgacggcaactccacctggcgccaccgatccctttccacagagtaattctcctattgaggacatcgagagggaaatccccgagcgcagctggaacacagggttcgactggattaccgattaccagggaaagactgtctggtttgtgccatccatcaaggctggcaatgacatagcgaactgcttgcgaaaatcaggtaagaaagtaattcaactatctagaaagacattcgataccgaatatccgaaaacgaagctgactgactgggattttgtggttacaaccgacatcagcgagatgggggccaatttccgggcaggcagggtcattgatcctcgcagatgtctcaagcccgtgatcagtaccgacggaccagaaagggtgatattagctggccccattcctgtcactccagcctccgcagcccagcggcgtgggcgcatcggacgaaaccccgctcaggaggatgaccaatacgttttcagcggtgatcctctgaaaaacgacgaggatcatgcccactggacagaagcgaagatgcttctggacaatatctataccccggagggcattatcccaacactctttgggcccgaaagagagaaaaaccaggcaattgacggagagttcaggttgcggggcgaacagcgcaagacttttgtggagctgatgagaaggggtgatctccctgtatggctgtcttacaaagtggcctcagctgggatatcctataaggaccgggaatggtgcttcacgggcgagcgaaataaccagatccttgaagagaatatggaggtcgaaatttggaccagagagggagaaaagaaaaagctacgccccaaatggctggatgccagggtgtacgctgacccaatggcattgaaggattttaaagagttcgccagtggccggaagagcatcacattagacatcctgactgaaattgcttcgctccctacctacctgtcttcccgtgccaagcttgcactggataacatagttatgctccacacaaccgagagagggggaaaagcgtatcaacatgccttgaatgagctgcccgaaagcctagagactctgatgctcgtggctcttctgggtgccatgacggcaggcatctttttattctttatgcaggggaagggaattggcaaattgtcaatgggtctgatcgctattgccgtcgcaagtgggctcctgtgggtagccgaaatccagccacagtggatagctgcgtctatcattcttgagttctttctgatggtgctcttgatccctgaaccggagaagcaaaggaccccccaggacaaccagctgatttacgttatcttaacaatactaactattatcggcctgattgccgcaaatgagatgggactcatcgaaaaaaccaagacagatttcggcttttatcaggtgaaaaccgagactacaatacttgacgtcgatctgcgcccagcttccgcctggacgttgtacgccgtggcaaccactatcctgacacctatgctccggcacaccattgaaaacaccagcgctaatctgtcacttgccgcgatcgctaaccaagccgcagtcctcatggggctgggaaagggctggcccttgcatcgaatggacctgggtgtgccattactagccatggggtgttatagtcaggttaatcctacaactctgattgctagcctcgtgatgcttctggtacactacgcaatcataggacccggcttgcaggccaaggcgacgagagaggctcagaaaaggaccgccgcaggtattatgaagaacccgacagtggatggcatcactgtcatcgacctggagccaatttcctatgaccctaaattcgaaaagcaactcgggcaggttatgctgcttgtgttatgcgccggacagctgctcttgatgcgcaccacatgggctttctgtgaggtcctgaccctagccactggccccgtgctgacgctctgggaagggaatccaggacggttttggaacacaaccatcgcagtatctactgctaacatattcagaggcagctaccttgccggtgcggggctggccttttccttgattaaaaatgcacaaaccccccgtaggggaacaggcactaccggtgagacactgggcgaaaagtggaagcggcagctcaactcactggatcgcaaagagttcgaggaatacaagcgatctgggatcttagaggtggacagaacggaagctaaaagtgcccttaaggatggatcgaaaattaagcatgcagttagcaggggctcctctaagatccggtggatagtggagcgcgggatggtcaaacctaagggaaaagtggtcgacctgggctgcggtagagggggatggtcatattacatggctaccctcaagaatgtgactgaagttaaaggctatacaaagggcgggccgggacacgaggagcccatcccaatggccacctacggttggaacctagtaaagctgcacagcggcgtggatgtcttttataaacctactgaacaggtggacacattgctgtgtgatattggggagtccagttctaatcccaccatcgaagagggaaggacgctccgagttcttaagatggtggaaccttggctgagctcaaaaccagagttctgcattaaggtcttgaacccctacatgcctaccgtgatcgaggaactggagaaactccagcggaagcatggcggttccttagtacgttgtccactgagtagaaatagcacacacgaaatgtattgggtgtctggggtttccggaaacattgtctcaagcgtgaatactacctcgaaaatgcttctgaaccgctttacaactaggcatcggaagcccacctacgagaaggacgtggatctaggcgccggcacaagatctgtcagtaccgagactgaaaaaccggacatgacgatcatagggcgcaggctccaacgactgcaggaggaacacaaggagacatggcactacgatcaggaaaatccttatcggacctgggcgtaccatggatcctatgaggctccaagcactggttcagcatcctctatggttaacggcgtggtaaaattgctgaccaagccctgggacgtgattcctatggtcacacagctcgccatgacggacaccactccattcgggcaacagagagtgtttaaagagaaggttgatacaaggaccccccagccgaagcctggaactcgcatggtgatgacaaccacagctaattggctttgggccctgttaggcaaaaagaaaaacccccgtctgtgcactcgggaagagttcatcagcaaggtcagaagtaatgcagccatcggtgctgtgtttcaggaagagcaagggtggacctccgcgagcgaagccgtaaacgactctaggttctgggagttggttgataaagagcgcgcactccaccaggaaggaaagtgtgagtcatgcgtgtacaatatgatgggcaagcgagaaaaaaagctgggcgagtttgggcgggctaaaggaagtagagccatttggtatatgtggctaggtgcaaggttccttgaattcgaggccctgggctttctcaacgaggaccattggttcgggcgcgaaaactcctggagcggagtcgagggcgaaggtctgcacagattggggtacatactggaggatatcgacaagaaagatggagacctcatttatgctgatgacacggccggctgggatacccggatcacagaggacgatcttctgaatgaagagttaattactgaacagatggcgccacatcacaagatcctggcaaaggccatatttaaattgacctaccaaaacaaggtggtgaaagtcctcaggcctacacccaagggcgctgttatggacatcatttctcgtaaagaccagcgagggtcgggacaggtgggtacttacggcctgaataccttcacgaacatggaggtacagctaatccgccaaatggaagccgagggggtgattacacaggatgacatgcacaatccaaagggacttaaagagagagtcgaaaagtggctgaaggagtgcggcgtggatcggctcaaaaggatggcaatctcaggtgacgattgtgttgtgaagcccctggacgaacgctttagcacctccttgttattcctgaacgatatggggaaagtcagaaaggacatacctcagtgggagccaagtaaaggatggaagaattggcaggaagtgccgttttgctctcatcacttccataagatttttatgaaagatggccggagcctcgtagttccctgtaggaaccaagacgagcttatcggccgagctcgtatctcccagggggccggatggtcactgagagagactgcttgcctaggtaaggcctatgcacagatgtggagtctgatgtacttccaccgccgggatctcaggttggcgtctatggccatttgtagcgctgtgcctacagaatggtttccaacctccagaactacctggtcaatacacgcccatcaccagtggatgacaacggaggacatgctgaaagtctggaatcgcgtgtggatcgaagacaaccccaatatgaccgataagactcctgttcatagctgggaggacattccatatcttggcaaacgggaagatctgtggtgcgggtctctcatcggattatccagtagggcaacatgggctaagaacattcacaccgccatcactcaagtgcgaaatctgataggcaaggaggagtacgtcgactatatgcccgtgatgaaaagatacagcgcacctttcgaatcggagggtgtattgtga

SEQ ID NO: 15810 - RNA, 9879 nt, synthetic construct
  misc_feature 1..9879: note = derived and/or modified CDS sequence (opt4) from DENV-1__AB608789__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacatcgactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccgtgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgagggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcgtgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggcccccgagagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagcagcagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacgtgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15811 - RNA, 9879 nt, synthetic construct
  misc_feature 1..9879: note = derived and/or modified CDS sequence (opt4) from DENV-1__AB608788__SS-prME
  source 1..9879: mol_type = other RNA
agcgtgaccatgctgctgatgctgctgcccaccgtgctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccaccaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagagtgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcaccatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctacgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagatgatcagaccccagcccatggagcacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccagcggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccgccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggcgccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagcagggcaccgcccaggtgatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacagactgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgagaacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgacagcgaccccgagggcgccctgtggtga

SEQ ID NO: 15812 - RNA, 9879 nt, synthetic construct
  misc_feature 1..9879: note = derived and/or modified CDS sequence (opt4) from DENV-1__AB608786__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcctggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagggcagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15813 - RNA, 9879 nt, synthetic construct
  misc_feature 1..9879: note = derived and/or modified CDS sequence (opt4) from DENV-1__AB608787__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcgtgcacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggatcagaaagatgctgatgaccggcaccctgggcgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagggcagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagacccacctgggccaccaacatccaggtggccatcaaccaggtgagaagactgatcggcaacgagaactacctggactacatgaccagcatgaagagattcaagaacgagagcgagcccgagggcgccctgtggtga

SEQ ID NO: 15814 - RNA, 9879 nt, synthetic construct
  misc_feature 1..9879: note = derived and/or modified CDS sequence (opt4) from DENV-1__HE795086__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcgtgagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggacggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagtacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15815 - RNA, 9879 nt, synthetic construct
  misc_feature 1..9879: note = derived and/or modified CDS sequence (opt4) from DENV-1__AB189120__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggccgtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgatgagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcaccgagagactgagaagaatggccatcagcggcgacgactgcgtggtgaagcccatcgacgacagattcgccaccgccctgaccgccctgaacgacatgggcaagatcagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15816 - RNA, 9879 nt, synthetic construct
  misc_feature 1..9879: note = derived and/or modified CDS sequence (opt4) from DENV-1__AB189121__SS-prME
  source 1..9879: mol_type = other RNA
agcgtgaccatgctgttcatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatggccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccatcatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgatccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagatgatcagaccccagcccatggagcacaagtacagctggaagagctggggcaaggccaagatcatcggcgccgacgtgcagaacatcaccttcatcatcgacggccccaacaccagcgagtgccccgacaaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccgtgagccagcacaactacagacccggctacttcacccagaccgccggcccctggcacctgggcaagctggagctggacttcgacctgtgcgagggcaccaccgtggtggtggacgagaactgcggcaacagaggccccagcctgagaaccaccaccgtgaccggcaagaccatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgaccatgggccagctgacctggaacgacctgatcagactgtgcatcatggtgggcgccaacgccagcgacatgatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtgggccaccctgctgagcctgaccttcgtgaagaccaccttcagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgctgctgatcaccgagaacaagatctggggcagaagaagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggacgaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagagagacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccccaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagaagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgttcgactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15817 - RNA, 9879 nt, synthetic construct
  misc_feature 1..9879: note = derived and/or modified CDS sequence (opt4) from DENV-1__AB195673__SS-prME
  source 1..9879: mol_type = other RNA
agcgtgaccatgctgctgatgctgctgcccaccgccctgaccttccacctgaccaccagaggcggcgagccccacatgatcgtgggcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagagcatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgaccatgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcgtgaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatgagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcgtggaggtggacagaagcgaggccaaggagggcctgaagagaggcgagaccatcaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatgggcgcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15818 - RNA, 9879 nt, synthetic construct
  misc_feature 1..9879: note = derived and/or modified CDS sequence (opt4) from DENV-1__AB204803__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgtgaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggccccttcaagctggagaaggaggtggccgagacccagcacggcaccgtgctggtgcaggtgaagtacgagggcaccgacgccccctgcaagatccccttcagcagccaggacgagaagggcgtgacccagaacggcagactgatcaccgccaaccccatcgtgaccgacaaggagaagcccatcaacatcgaggccgagccccccttcggcgagagctacatcgtggtgggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcagagccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcagtgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgaccatgggccagctgacctggaacgacctgatcagactgtgcatcatggtgggcgccaacgccagcgacaagatgggcatgggcaccacctacctggccctgatggccaccttcagaatgagacccatgttcgccgtgggcctgctgttcagaggcctgaccagcagagaggtgctgctgctgaccgtgggcctgagcctggtggccagcgtggagctgcccaacagcctggaggagctgggcgacggcctggccatgggcatcatgatgctgaagctgctgaccgacttccagagccaccagctgtgggccaccctgctgagcctgaccttcgtgaagaccaccttcagcctgcactacgcctggaagaccatggccatgaccctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccatcaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaccgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatgagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgagacccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaagccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15819 - RNA, 9879 nt, synthetic construct
  misc_feature 1..9879: note = derived and/or modified CDS sequence (opt4) from DENV-1__LC016760__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagatacagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatcgccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccatcaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagtgcgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgagatcatggagcccgagcacgcccagctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatgaaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15820 - RNA, 9879 nt, synthetic construct
  misc_feature 1..9879: note = derived and/or modified CDS sequence (opt4) from DENV-1__LC128301__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactgatcaccgccaaccccatcgtgaccgacaaggagaagcccgtgaacatcgaggccgagccccccttcggcgagagctacctggtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgaacggcatcctggcccagggcaagaagatgatcagaccccagcccatggagcacaagtacagctggaagagctggggcaaggccaaggtgatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctgaccagagccagcttcatcgaggtgaagacctgcatctggcccaagagccacaccctgtggagcaacggcgtgctggagagcgagatgatcatccccaagacctacggcggccccatcagccagcacaactacagacccggctacttcacccagaccgccggcccctggcacctgggcaagctggagctggacttcggcctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgagaagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagagccaccagctgtgggccgccctgctgagcctgaccttcgtgaagaccaccttcagcctgcactacgcctggaagaccatggccatgatcctgagcatcatcagcctgttccccctgtgcatgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcaagagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcatggaggccttcccccagagcaacgccgccatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagagccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagaaggacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15821 - RNA, 9879 nt, synthetic construct
  misc_feature 1..9879: note = derived and/or modified CDS sequence (opt4) from DENV-1__LC011945__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagatacagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatcgccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggcagcgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccatcaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagtgcgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgagatcatggagcccgagcacgcccagctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatgaaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15822 - RNA, 9879 nt, synthetic construct
  misc_feature 1..9879: note = derived and/or modified CDS sequence (opt4) from DENV-1__LC011949__SS-prME
  source 1..9879: mol_type = other RNA
agcgtgaccatgctgctgatgctggtgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacaccggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcatcagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15823 - RNA, 9879 nt, synthetic construct
  misc_feature 1..9879: note = derived and/or modified CDS sequence (opt4) from DENV-1__HM469966__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtggtgctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatcgccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatcctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtggaagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15824 - RNA, 9879 nt, synthetic construct
  misc_feature 1..9879: note = derived and/or modified CDS sequence (opt4) from DENV-1__JX669462__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggagacagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccctgaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15825 - RNA, 9879 nt, synthetic construct
  misc_feature 1..9879: note = derived and/or modified CDS sequence (opt4) from DENV-1__JX669463__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggagacagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccctgaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15826 - RNA, 9879 nt, synthetic construct
  misc_feature 1..9879: note = derived and/or modified CDS sequence (opt4) from DENV-1__JX669464__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgagatggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagatccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15827 - RNA, 9879 nt, synthetic construct
  misc_feature 1..9879: note = derived and/or modified CDS sequence (opt4) from DENV-1__JX669465__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagacctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgagatggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaagatcagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15828 - RNA, 9879 nt, synthetic construct
  misc_feature 1..9879: note = derived and/or modified CDS sequence (opt4) from DENV-1__JX669466__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggagacagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccatcctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacctgggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15829 - RNA, 9879 nt, synthetic construct
  misc_feature 1..9879: note = derived and/or modified CDS sequence (opt4) from DENV-1__JX669467__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccaccgtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15830 - RNA, 9879 nt, synthetic construct
  misc_feature 1..9879: note = derived and/or modified CDS sequence (opt4) from DENV-1__HM469967__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgagatcggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacagcgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtggaagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgaagtggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaaagaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagaaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15831 - RNA, 9879 nt, synthetic construct
  misc_feature 1..9879: note = derived and/or modified CDS sequence (opt4) from DENV-1__JX669468__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcaacggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccaccgtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15832 - RNA, 9879 nt, synthetic construct
  misc_feature 1..9879: note = derived and/or modified CDS sequence (opt4) from DENV-1__JX669469__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcaaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatggcccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatcctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15833 - RNA, 9879 nt, synthetic construct
  misc_feature 1..9879: note = derived and/or modified CDS sequence (opt4) from DENV-1__JX669470__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgtggtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacctgtggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgagaaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15834 - RNA, 9879 nt, synthetic construct
  misc_feature 1..9879: note = derived and/or modified CDS sequence (opt4) from DENV-1__JX669471__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccctgaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgtgcccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgacagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15835 - RNA, 9879 nt, synthetic construct
  misc_feature 1..9879: note = derived and/or modified CDS sequence (opt4) from DENV-1__JX669472__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatgaagttcaccgtggtggtgggcaacgccaacggcatcctggcccagggcaagaagatgatcaagccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccaccgtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15836 - RNA, 9879 nt, synthetic construct
  misc_feature 1..9879: note = derived and/or modified CDS sequence (opt4) from DENV-1__JX669473__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccagcagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatgaagttcaccgtggtggtgggcaacgccaacggcatcctggcccagggcaagaagatgatcaagccccagcccatggagcacaagtacagctggaagagctggggcaaggccaagatcatcggcgccgacatccagaacgccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccaccgtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15837 - RNA, 9879 nt, synthetic construct
  misc_feature 1..9879: note = derived and/or modified CDS sequence (opt4) from DENV-1__JX669474__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatgaagttcaccgtggtggtgggcaacgccaacggcatcctggcccagggcaagaagatgatcaagccccagcccatggagcacaagtacagctggaagagctggggcaaggccaagatcatcggcgccgacatccagaacgccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccaccagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccaccgtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15838 - RNA, 9879 nt, synthetic construct
  misc_feature 1..9879: note = derived and/or modified CDS sequence (opt4) from DENV-1__JX669475__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgagcttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15839 - RNA, 9879 nt, synthetic construct
  misc_feature 1..9879: note = derived and/or modified CDS sequence (opt4) from DENV-1__JX669461__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgagatggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccctgaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15840 - RNA, 9879 nt, synthetic construct
  misc_feature 1..9879: note = derived and/or modified CDS sequence (opt4) from DENV-1__KF184975__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccgaggaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcatccaggacgagaagggcgtgatccagaacggcagactgatcaccgccaaccccatcgtgaccgacaaggagaagcccgtgaacatcgagaccgagccccccttcggcgagagctacatcgtggtgggcgccggcgagaagaccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtgaacggcatcctggcccagggcaagaagatggtgagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgagaagcatggtgagcgccggcagcggcgaggtggacaacttcagcctgggcctgctgtgcgtgagcatcatggtggaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcgtgaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgccagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggccgagaaggccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagagtggagcccagctgggccagcgtgaagaaggacctgatcagctacggcggcggctggagattccagggcctgtggaacaccggcgaggaggtgcaggtgatcgccgtggagcccggcaagaaccccagaaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagaccgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcagactgccccagcacctgaccctgaaggcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgccgaggaccaccagcacgccaccatgctggacgtggacctgagacccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcaccgaggtggacagaagcgaggccaaggagggcctgaagagaggcgagaccaccaagcacgccgtgagcagaggcgccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15841 - RNA, 9879 nt, synthetic construct
  misc_feature 1..9879: note = derived and/or modified CDS sequence (opt4) from DENV-1__KT831765__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagatacagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcatgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccatcaacatgaccagcagaatgctgctgaacagattcaccatggcccacagaaagcccacctacgagagagacgtggacctgggcgccggcaccagacacgtgaccgtggagcccgaggtggccaacctggacatcatcggccagagaatcgagaacatcaagtgcgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgagatcatggagcccgagcacgcccagctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15842 - RNA, 9879 nt, synthetic construct
  misc_feature 1..9879: note = derived and/or modified CDS sequence (opt4) from DENV-1__KP188567__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcaagccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccctggacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccagcagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggcaccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgccgactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15843 - RNA, 9879 nt, synthetic construct
  misc_feature 1..9879: note = derived and/or modified CDS sequence (opt4) from DENV-1__KP188568__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgagatggacagcttcagcctgggcatcctgtgcgtgagcatcctgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccagcatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgccatccaggacgaggagagagacatccccgagagaagctggaacaccggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtgggtggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcgtgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15844 - RNA, 9879 nt, synthetic construct
  misc_feature 1..9879: note = derived and/or modified CDS sequence (opt4) from DENV-1__KF971870__SS-prME
  source 1..9879: mol_type = other RNA
agcgtgaccatgctgctgatgctgatgcccaccgccctggccttccacctgaccaccagaggcggcgagccccacatgatggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcagcgccatcaaggacagcaaggccgtgcacgccgacatgggctactggatcgagagcgagaagaacgacacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgatcggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgttccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagagagaagctgagacccagatggctgggcgccagaacctacagcgaccccctggccctgagagacttcaaggagttcgccgccggcagaagaagcgtgagcggcgacctgatcctggagatcggcaagctgccccagcacctgacccagagagcccagaacgccctggacaacctggtgatgctgcacaacagccagcagggcggcagagcctacacccacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagaagactgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcaactgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15845 - RNA, 9879 nt, synthetic construct
  misc_feature 1..9879: note = derived and/or modified CDS sequence (opt4) from DENV-1__KF971871__SS-prME
  source 1..9879: mol_type = other RNA
agcgtgaccatgctgctgatgctgatgcccaccgccctggccttccacctgaccaccagaggcggcgagccccacatgatggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgacacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgatcggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgttccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctgggcgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagaagactgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcaactgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15846 - RNA, 9879 nt, synthetic construct
  misc_feature 1..9879: note = derived and/or modified CDS sequence (opt4) from DENV-1__KF971869__SS-prME
  source 1..9879: mol_type = other RNA
agcgtgaccatgctgctgatgctgatgcccaccgccctggccttccacctgaccaccagaggcggcgagccccacatgatggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgacacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgatcggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgttccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagaagactgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcaactgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15847 - RNA, 9879 nt, synthetic construct
  misc_feature 1..9879: note = derived and/or modified CDS sequence (opt4) from DENV-1__JN903578__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaaggtggtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgatccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagcagattcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcaccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgagatcaagacctgcatctggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacgtgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatcaccatgatcctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacggcgaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcagcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccaccatgaagagattcaagaacgagagcgaccccgagggcgccctgtggtga

SEQ ID NO: 15848 - RNA, 9879 nt, synthetic construct
  misc_feature 1..9879: note = derived and/or modified CDS sequence (opt4) from DENV-1__JN903579__SS-prME
  source 1..9879: mol_type = other RNA
agcgtgaccatgctgctgatgctgctgcccaccgccctggccttccacctgaccaccagaggcggcgagccccacatgatcgtgggcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacaccggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatcgccatgatcctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccatcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcagcctgttcatgatcctgaccgtggccgccaacgagatgggcctgctggagaccaccaagaaggacctgggcatcggccacgtggtggccgagaaccaccaccacgccaccaccctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgtacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacaccaccagcatgaagagattcaagaacgagagcgaccccgagggcgccctgtggtga

SEQ ID NO: 15849 - RNA, 9879 nt, synthetic construct
  misc_feature 1..9879: note = derived and/or modified CDS sequence (opt4) from DENV-1__JN903580__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaaacaccagcctgagcatgacctgcatcgccgtgggcatggtgaccctgtacctgggcgtgatggtgcaggccgacaccggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgaagagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatcgccatgatcctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttcagaaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagagacaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatggagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgtacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgaccccgagggcgccctgtggtga

SEQ ID NO: 15850 - RNA, 9879 nt, synthetic construct
  misc_feature 1..9879: note = derived and/or modified CDS sequence (opt4) from DENV-1__JN903581__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaaacaccagcctgagcatgacctgcatcgccgtgggcatggtgaccctgtacctgggcgtgatggtgcaggccgacaccggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgtgatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggaggaggaggagaacctggtgagaagcatggtgagcgccggcagcggcgaggtggacagcttcagcctgggcctgctgtgcgtgagcatcatgatcgaggaggtgatgaagagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatgctgaagctgctggccgacttccagagccaccagctgtggaccaccctgctgagcctgaccttcatcaagaccaccctgagcctggactacgcctggaagaccatcgccatgatcctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcgacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctggagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgtgaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgtacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgaccccgagggcgccctgtggtga

SEQ ID NO: 15851 - RNA, 9879 nt, synthetic construct
  misc_feature 1..9879: note = derived and/or modified CDS sequence (opt4) from DENV-1__KX380796__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatgcagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagaccgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcaacggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcagattctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15852 - RNA, 9879 nt, synthetic construct
  misc_feature 1..9879: note = derived and/or modified CDS sequence (opt4) from DENV-1__KX380799__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcagattctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15853 - RNA, 9879 nt, synthetic construct
  misc_feature 1..9879: note = derived and/or modified CDS sequence (opt4) from DENV-1__KX380800__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccatcttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15854 - RNA, 9879 nt, synthetic construct
  misc_feature 1..9879: note = derived and/or modified CDS sequence (opt4) from DENV-1__KX380802__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatgggcaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15855 - RNA, 9879 nt, synthetic construct
  misc_feature 1..9879: note = derived and/or modified CDS sequence (opt4) from DENV-1__KX380797__SS-prME
  source 1..9879: mol_type = other RNA
agcgtgaccgtgctgctgatgctgctgcccaccgccctggccttccacctgaccaccagaggcggcgagccccacatgatcgtgagcaagcaggagagaggcaagagcctgctgttcaagaccagcaccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccctggtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcaccagccaggacgagaagggcgtgacccagaacggcagactgatcaccgccaaccccatcgtgaccgacaaggagaagcccgtgaacatcgaggccgagccccccttcggcgagagctacctggtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgaacggcatcctggcccagggcaagaagatgatcagaccccagcccatggagcacaagtacagctggaagagctggggcaaggccaaggtgatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctgaccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcggcctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcagaatgagacccatgttcgccgtgggcctgctgttcagaagactgaccagcagagaggtgctgctgagaagcgtgggcctgagcctggtggccagcgtggagctgcccaacagcctggaggagctgggcgacggcctggccatgggcatcatgatgctgaagctgctgaccgacttccagagccaccagctgtgggccgccctgctgagcctgaccttcgtgaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcaagagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcatggaggccttcccccagagcaacgccgccatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagagccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgaccaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcatcgagagactgaagagaatggccatcagcggcgacgactgcgtggtgaagcccgtggacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15856 - RNA, 9879 nt, synthetic construct
  misc_feature 1..9879: note = derived and/or modified CDS sequence (opt4) from DENV-1__KX380805__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgagcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15857 - RNA, 9879 nt, synthetic construct
  misc_feature 1..9879: note = derived and/or modified CDS sequence (opt4) from DENV-1__KX380798__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15858 - RNA, 9879 nt, synthetic construct
  misc_feature 1..9879: note = derived and/or modified CDS sequence (opt4) from DENV-1__KJ649286__SS-prME
  source 1..9879: mol_type = other RNA
agcgtgaccatgctgctgatgctgctgcccaccgtgctggccttccacctgaccaccagaggcggcgagccccacatgatcgtgaccaagcaggagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacatcgactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccaccaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggtggagacccagcacggcaccgtgctggtgcaggtgaagtacgagggcaccgacgccccctgcaagatccccttcctgacccaggacgagaagggcgtgacccagaacggcagagtgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcaccatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagatgatcagaccccagcccatggagcacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccgccctgctgagcctgaccttcatcaagaccacctgcagcctgcactacgcctggaagaccatggccatggtgctgagcatcgtgagcctgttccccctgtgcatgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctggtggccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtacaagggcaagagactggagcccacctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagagcgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcatgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccatgaccctgaccgccgccgtgctgatgctggtggcccactacaccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggcgccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccaggtgatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacagactgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcctgttcagccccagcgagctggagacccccaacctggccgagagagtgctgaactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgagaacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaaagctgatcggcaacgagaactacctggactacatgaccagcatgaagagattcaagaacgacagcgaccccgagggcgccctgtggtga

SEQ ID NO: 15859 - RNA, 9879 nt, synthetic construct
  misc_feature 1..9879: note = derived and/or modified CDS sequence (opt4) from DENV-1__KF887994__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgctggaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatcggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctgatggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggtactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtggtgagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggcctggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaaagctgatcggcaacgagaactacctggactacatgaccagcatgaagagattcaagaacgagagcgaccccgagggcgccctgtggtga

SEQ ID NO: 15860 - RNA, 9879 nt, synthetic construct
  misc_feature 1..9879: note = derived and/or modified CDS sequence (opt4) from DENV-1__JQ675358__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagagaagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagacctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcctgctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctggtgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccagaaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcgtgggcggcggcagaagaggcatgggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgcacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15861 - RNA, 9879 nt, synthetic construct
  misc_feature 1..9879: note = derived and/or modified CDS sequence (opt4) from DENV-1__FJ850070__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgccagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagagcagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15862 - RNA, 9879 nt, synthetic construct
  misc_feature 1..9879: note = derived and/or modified CDS sequence (opt4) from DENV-1__FJ850071__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaaagctgaccagcagagaggtgctgctgctgaccatcggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15863 - RNA, 9879 nt, synthetic construct
  misc_feature 1..9879: note = derived and/or modified CDS sequence (opt4) from DENV-1__FJ850073__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccgacggcatcctggcccagggcaagaagatgatcagaccccagcccatggagcacaagtacagctggaagagctggggcaaggccaagatcatcggcgccgacatccagaacaccaccttcatcatcgacggccccgacaccctggagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccgtgagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcgtgctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggtggagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatggccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgagaaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttcagcagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacggcaactacctggactacatgaccagcatgaagagattcaagaacgagagcgaccccgagggcgccctgtggtga

SEQ ID NO: 15864 - RNA, 9879 nt, synthetic construct
  misc_feature 1..9879: note = derived and/or modified CDS sequence (opt4) from DENV-1__FJ850075__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagaccatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15865 - RNA, 9879 nt, synthetic construct
  misc_feature 1..9879: note = derived and/or modified CDS sequence (opt4) from DENV-1__FJ850077__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggtggagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcaggtgcagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaaagctgaccagcagagaggtgctgctgctgaccatcggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacagaatctggggcagaaagagctggcccatcaacgagggcgtgatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccaccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagacatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15866 - RNA, 9879 nt, synthetic construct
  misc_feature 1..9879: note = derived and/or modified CDS sequence (opt4) from DENV-1__FJ850081__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgccgaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15867 - RNA, 9879 nt, synthetic construct
  misc_feature 1..9879: note = derived and/or modified CDS sequence (opt4) from DENV-1__FJ850084__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggtggagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcgccgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaaagctgaccagcagagaggtgctgctgctgaccatcggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccaccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagacatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15868 - RNA, 9879 nt, synthetic construct
  misc_feature 1..9879: note = derived and/or modified CDS sequence (opt4) from DENV-1__FJ850087__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggtggtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgctgcaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15869 - RNA, 9879 nt, synthetic construct
  misc_feature 1..9879: note = derived and/or modified CDS sequence (opt4) from DENV-1__FJ850090__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggtggagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgatccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaaagctgaccagcagagaggtgctgctgctgaccatcggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccaccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtgggacttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagacatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15870 - RNA, 9879 nt, synthetic construct
  misc_feature 1..9879: note = derived and/or modified CDS sequence (opt4) from DENV-1__FJ850093__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacccacctggccctgatggccaccttcaagatgagacccatgttcgccgtgggcctgctgttcagaagactgaccagcagagaggtgctgctgctgaccatcggcctgagcctgatggccagcatggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatgatcctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagaccaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagagagtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15871 - RNA, 9879 nt, synthetic construct
  misc_feature 1..9879: note = derived and/or modified CDS sequence (opt4) from DENV-1__GU131863__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacatcaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15872 - RNA, 9879 nt, synthetic construct
  misc_feature 1..9879: note = derived and/or modified CDS sequence (opt4) from DENV-1__GQ868559__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggaggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15873 - RNA, 9879 nt, synthetic construct
  misc_feature 1..9879: note = derived and/or modified CDS sequence (opt4) from DENV-1__GQ868560__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcatcaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggaggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacatcgactacatgaccagcatgaagagattcaagaacgagagcgaccccgagggcgccctgtggtga

SEQ ID NO: 15874 - RNA, 9879 nt, synthetic construct
  misc_feature 1..9879: note = derived and/or modified CDS sequence (opt4) from DENV-1__GQ868561__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccagccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaccaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15875 - RNA, 9879 nt, synthetic construct
  misc_feature 1..9879: note = derived and/or modified CDS sequence (opt4) from DENV-1__GU131948__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagagatcctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcatcttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcatcagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacaccccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15876 - RNA, 9879 nt, synthetic construct
  misc_feature 1..9879: note = derived and/or modified CDS sequence (opt4) from DENV-1__GQ868562__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagcacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacccacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgccaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15877 - RNA, 9879 nt, synthetic construct
  misc_feature 1..9879: note = derived and/or modified CDS sequence (opt4) from DENV-1__GQ868563__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacgccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcctgtggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgccgccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtgcccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggagtgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15878 - RNA, 9879 nt, synthetic construct
  misc_feature 1..9879: note = derived and/or modified CDS sequence (opt4) from DENV-1__GQ868564__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaaggccctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagagagaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcacgaggccgagcacagcggcgccagccacaacatcctggtggaggtgcaggacgacggcaccatgaagatcaaggacgaggagagagacgacaccctgaccatcctgctgaaggccgccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggagtgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15879 - RNA, 9879 nt, synthetic construct
  misc_feature 1..9879: note = derived and/or modified CDS sequence (opt4) from DENV-1__GQ868565__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacgccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcctgtggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgccgccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggagtgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15880 - RNA, 9879 nt, synthetic construct
  misc_feature 1..9879: note = derived and/or modified CDS sequence (opt4) from DENV-1__GQ868568__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggatcatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacacccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggagtgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15881 - RNA, 9879 nt, synthetic construct
  misc_feature 1..9879: note = derived and/or modified CDS sequence (opt4) from DENV-1__GQ868569__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtggccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacgccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcctgtggaacatgggcgaggaggtgcaggtgatcgccgtggagcccggcaagaaccccagaaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgccgccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggagtgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15882 - RNA, 9879 nt, synthetic construct
  misc_feature 1..9879: note = derived and/or modified CDS sequence (opt4) from DENV-1__GQ868570__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaaggtgggcatcggcatcctgctgacctggctgggcctgaacagcagaagcaccagcctgagcatgacctgcatcgccgtgggcatggtgaccctgtacctgggcgtgatggtgcaggccgacctgggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacacccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacaagcagagaaccccccaggacaaccagctggcctacgtggtgatcggcctgctgttcatgatcctggccgtggccgccaacgagatgggcctgctggagaccaccaagaaggacctgggcatcggctacgtggccaccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccgccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15883 - RNA, 9879 nt, synthetic construct
  misc_feature 1..9879: note = derived and/or modified CDS sequence (opt4) from DENV-1__KJ189302__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccagccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15884 - RNA, 9879 nt, synthetic construct
  misc_feature 1..9879: note = derived and/or modified CDS sequence (opt4) from DENV-1__KJ189303__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacacccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggagtgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15885 - RNA, 9879 nt, synthetic construct
  misc_feature 1..9879: note = derived and/or modified CDS sequence (opt4) from DENV-1__KR028435__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatctgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagggcggcatcagcgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15886 - RNA, 9879 nt, synthetic construct
  misc_feature 1..9879: note = derived and/or modified CDS sequence (opt4) from DENV-1__JQ922548__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacaccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccagaaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccatgagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccaggccaagaagcaggaggtggtggtgctgggcagccaggagggcgccatgcacaccgccctgaccggcgccaccgagatccagaccagcggcaccaccaccatgttcgccggccacctgaagtgcagactgaagatggacaagctgaccctgaagggcgccagctacgtgatgtgcaccggccccttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgccttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacgcccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctgaccagagccagcttcatcgaggtgaagacctgcacctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacggcggcgccagcctgggcaccaccaccgtgaccggcaagatcatccacgagtggtgctgcagaagctgcaccctgccccccctgagattcctgggcgaggacggctgctggtacggcatggagatcagacccgtgaaggagaaggaggagaacctgttcagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatcggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatcgccatggtgctgagcatcgtgagcctgttccccctgtgcctgagcaccaccagccagaagaccacctggctgcccgtgctgctgggcagcttcggcagcaagcccctgaccatgttcctgatcaccgagaacaagatctggggcagaaagagctggcccctgaacgagggcatcatggccgtgggcatcgtgagcatcctgctgagcagcctgcccaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaacatgaagatcaaggacgaggagagagacgacagcctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggtgagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaacttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacagcagaaccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgaaggagctgctgatccccgacgccgacggccagagaaccccccaggacaaccagctggcctacgtggtgatcggcctgctgttcatgatcctgaccgtggccgccaacgagatgggcctgctggagaccaccaagaagaacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggcagacccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcctgatgaagaaccccaccgtggacggcatcgccgccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcgccaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcacctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagccctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgcgagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggccgacgtgccctacctgggcaagagagaggaccagtggtgcggcagcctgatcggcctggccgccagagccacctgggccaccaacatccaggtggccctgaaccaggtgagaagactgatcggcaacgagaactacctggactacatgaccagcatgaagagattcaagaacgagagcgaccccgagggcgccctgtggtga

SEQ ID NO: 15887 - RNA, 9879 nt, synthetic construct
  misc_feature 1..9879: note = derived and/or modified CDS sequence (opt4) from DENV-1__JQ922544__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagctgcgagggcgcctggaagcagatccagaaggtggagatctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagagttcgtggagggcctgagcggcgccacctgggtggacgtggtgctggagcacggcagctgcctgcacaccatggcccagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccacccacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggatcatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggaggagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcagcttcttcgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgaacatgggccagcccctgaacaacgacgaggaccacgcccactggaccgaggccaagatgctgctggacaacatcaacacccccgagggcatcatccccgccctgttcgagcccgagagaaagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagagagagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcctgatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatgggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacaagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacaaggtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15888 - RNA, 9879 nt, synthetic construct
  misc_feature 1..9879: note = derived and/or modified CDS sequence (opt4) from DENV-1__JQ922546__SS-prME
  source 1..9879: mol_type = other RNA
agcgtggccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtggcccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccatcatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcatccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgttcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgagccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccagcctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcatcttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcatcttcaagacccccgagggcgaggtgggcgccatcaccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatgaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggaccacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacaccgacagaagatggtgcttcgacggcgagagaaacaaccaggtgctggaggagaacatggacgtggagatctggatggaggagggcgagaagaagaagatcagacccagatggctggagatcgagaagtacagcgaccccctggccctgagagagttcaaggagttcagcgccaagagaaagagcgtgctgggcgacctgaagctggagatcggcaagctgccccagcacctgaccatcaaggccagaaacgccctggacaacctggtgatgctgcacaacagcgagcagggcggcaaggcctacagacacgccatggaggagctgcccgacaccatcgagaccctgatgagactgggcctgatcgccgtgatgaccggcggcgtgaccctgttcttcctgagcggcaagggcctgggcaagaccagcaacggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccccccagatcatgaagaaccagatcgtggacggcatcgtggccgtggacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccaccgtgacccagatcgccatgaccgacaccacccccttcggccagcagagagtgttcaaggagaaggtggacaccagaacccccaaggccaagagaggcaccgcccagatcatggaggtgaccgccaactggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctgaactggctggagaagcacggcgtggagagactgaagagaatggccatcagcggcgacgactgcgtggtgaagcccaccgacgacagattcgccaccgccctgaccgccctgaacgacatgggcaaggtgagaaaggacaccccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccacggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcatcatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15889 - RNA, 9879 nt, synthetic construct
  misc_feature 1..9879: note = derived and/or modified CDS sequence (opt4) from DENV-1__JQ922545__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacaccatcggcaccagcatcacccagaagggcatcatcttcatcctgctgatgaccggcgcccccatcatggccatgagatgcgtgggcatcggcaacagagacttcgtggagggcctgagcggcgccccctgggtggacgtggtgctggagcacggcagctgcctgagcaacatggccaagaacaagcccaccctggacatcgacttcttcaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagatgagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccacctgcctggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatcgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggcccagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcagcgacatcgccaccgtgctggagagaagcagagagcccgtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatccccaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcgagaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcatcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagatcggccacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggatgtggggcttcctgttcagaaacagaccccccagaatctgcaccagagacgagttcgccagaaaggtgagaagcagcaccgccaacggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacagcagcaacgaggccaagatcatcgagctgatgagacccgagcacgccctgctggccaccagcatcttcaagctgaccttccagatcagcgtggtgagagtgcagagacccgccaagagcggcaccgtgatggagtgcatcagcagaagagaccagaagagaagcggccaggtgggcacctacggcctgaacaccttcaccaacatggaggtgcagctgatcagacagatggagagcgagggcatcttcagccccagcgagatggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15890 - RNA, 9879 nt, synthetic construct
  misc_feature 1..9879: note = derived and/or modified CDS sequence (opt4) from DENV-1__GU131887__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcagatacgagggcaccgacgccccctgcaagatccccttcagcacccaggacgagagaggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggagaagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgccctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagatcaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15891 - RNA, 9879 nt, synthetic construct
  misc_feature 1..9879: note = derived and/or modified CDS sequence (opt4) from DENV-1__GU131888__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagagcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccggctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggccccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccctgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15892 - RNA, 9879 nt, synthetic construct
  misc_feature 1..9879: note = derived and/or modified CDS sequence (opt4) from DENV-1__GU131892__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15893 - RNA, 9879 nt, synthetic construct
  misc_feature 1..9879: note = derived and/or modified CDS sequence (opt4) from DENV-1__GU131893__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaagccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggtgtggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15894 - RNA, 9879 nt, synthetic construct
  misc_feature 1..9879: note = derived and/or modified CDS sequence (opt4) from DENV-1__GU131894__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggacccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15895 - RNA, 9879 nt, synthetic construct
  misc_feature 1..9879: note = derived and/or modified CDS sequence (opt4) from DENV-1__GU131895__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctggccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15896 - RNA, 9879 nt, synthetic construct
  misc_feature 1..9879: note = derived and/or modified CDS sequence (opt4) from DENV-1__GQ868632__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgagcagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagagagaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcttcctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15897 - RNA, 9879 nt, synthetic construct
  misc_feature 1..9879: note = derived and/or modified CDS sequence (opt4) from DENV-1__GQ868633__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgaggccaccaagcacgccgtgagcagaggccccgccaagctgagatggttcgtggagagaaacctggtgaaccccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactgggtgagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctggagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15898 - RNA, 9879 nt, synthetic construct
  misc_feature 1..9879: note = derived and/or modified CDS sequence (opt4) from DENV-1__GU131919__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgcctgcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15899 - RNA, 9879 nt, synthetic construct
  misc_feature 1..9879: note = derived and/or modified CDS sequence (opt4) from DENV-1__GU131920__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacagagagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15900 - RNA, 9879 nt, synthetic construct
  misc_feature 1..9879: note = derived and/or modified CDS sequence (opt4) from DENV-1__GU131921__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatggccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccatgaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcgccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagaaggccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15901 - RNA, 9879 nt, synthetic construct
  misc_feature 1..9879: note = derived and/or modified CDS sequence (opt4) from DENV-1__GQ868635__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatggccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcgccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagaaggccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15902 - RNA, 9879 nt, synthetic construct
  misc_feature 1..9879: note = derived and/or modified CDS sequence (opt4) from DENV-1__GQ868636__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcctgggcgaggtggacagcttcagcctgggcctgctgtgcatcagcatcatgatcgaggaggtgatgagaagcagatggagcagaaagatgctgatggccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcaccacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagagatgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 15903 - RNA, 9879 nt, synthetic construct
  misc_feature 1..9879: note = derived and/or modified CDS sequence (opt4) from DENV-1__GU131922__SS-prME
  source 1..9879: mol_type = other RNA
agcgtgatcatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15904 - RNA, 9879 nt, synthetic construct
  misc_feature 1..9879: note = derived and/or modified CDS sequence (opt4) from DENV-1__GU131923__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccgtggtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcatcacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcaagagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgaggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15905 - RNA, 9879 nt, synthetic construct
  misc_feature 1..9879: note = derived and/or modified CDS sequence (opt4) from DENV-1__GQ868637__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagagagaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgatcgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgacgagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15906 - RNA, 9879 nt, synthetic construct
  misc_feature 1..9879: note = derived and/or modified CDS sequence (opt4) from DENV-1__GQ868639__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctggccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgccgaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15907 - RNA, 9879 nt, synthetic construct
  misc_feature 1..9879: note = derived and/or modified CDS sequence (opt4) from DENV-1__GU131925__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15908 - RNA, 9879 nt, synthetic construct
  misc_feature 1..9879: note = derived and/or modified CDS sequence (opt4) from DENV-1__GU131926__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcgtgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgccgaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15909 - RNA, 9879 nt, synthetic construct
  misc_feature 1..9879: note = derived and/or modified CDS sequence (opt4) from DENV-1__FJ639669__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15910 - RNA, 9882 nt, synthetic construct
  misc_feature 1..9882: note = derived and/or modified CDS sequence (opt4) from DENV-1__FJ639670__SS-prME
  source 1..9882: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgtgagcagaaagaacctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatcgccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagcagcaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15911 - RNA, 9879 nt, synthetic construct
  misc_feature 1..9879: note = derived and/or modified CDS sequence (opt4) from DENV-1__FJ639671__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacggcaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacaccagcgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcagagccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgagaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15912 - RNA, 9879 nt, synthetic construct
  misc_feature 1..9879: note = derived and/or modified CDS sequence (opt4) from DENV-1__JN819423__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacggcaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacaccagcgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcagagccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgagaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccagcagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15913 - RNA, 9879 nt, synthetic construct
  misc_feature 1..9879: note = derived and/or modified CDS sequence (opt4) from DENV-1__FJ639672__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcagcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgccttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15914 - RNA, 9879 nt, synthetic construct
  misc_feature 1..9879: note = derived and/or modified CDS sequence (opt4) from DENV-1__FJ639673__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15915 - RNA, 9879 nt, synthetic construct
  misc_feature 1..9879: note = derived and/or modified CDS sequence (opt4) from DENV-1__FJ639674__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcatgagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgtgaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15916 - RNA, 9879 nt, synthetic construct
  misc_feature 1..9879: note = derived and/or modified CDS sequence (opt4) from DENV-1__FJ639675__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcctgttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcagcgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15917 - RNA, 9879 nt, synthetic construct
  misc_feature 1..9879: note = derived and/or modified CDS sequence (opt4) from DENV-1__FJ639676__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgccggcctgggcctggagaccagagccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcttcatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcatcagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcctggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggacttcatgaccagcatgaagagattcaagaacgagagcgacaccgagggcgccctgtggtga

SEQ ID NO: 15918 - RNA, 9879 nt, synthetic construct
  misc_feature 1..9879: note = derived and/or modified CDS sequence (opt4) from DENV-1__FJ639677__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagagtgaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccatgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgaagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaagcaagaagcccagaatctgcaccagagaggagttcatcagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15919 - RNA, 9879 nt, synthetic construct
  misc_feature 1..9879: note = derived and/or modified CDS sequence (opt4) from DENV-1__GQ868618__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15920 - RNA, 9879 nt, synthetic construct
  misc_feature 1..9879: note = derived and/or modified CDS sequence (opt4) from DENV-1__GQ868619__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccatcatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgatgctgttcttcctgagcggcagaggcctgggcaagaccagcatcggcctgctgtgcgtgatggccagcagcggcctgctgtggatggccagcgtggagccccactggatcgccgccagcatcatcctggagttcttcctgatggtgctgctgatccccgagcccgacagacagagaaccccccaggacaaccagctggcctacgtggtgatgggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15921 - RNA, 9879 nt, synthetic construct
  misc_feature 1..9879: note = derived and/or modified CDS sequence (opt4) from DENV-1__FJ639678__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaaggccctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacgccaccgacacctgggtgacctacggcacctgcccccagaccggcgagcacagaagagacagaagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagtacaagtacagctggaagagctggggcaaggccaagatcatcggcgccgacatccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcctgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccaggagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagcagggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgagaaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15922 - RNA, 9879 nt, synthetic construct
  misc_feature 1..9879: note = derived and/or modified CDS sequence (opt4) from DENV-1__FJ639679__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgccagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15923 - RNA, 9879 nt, synthetic construct
  misc_feature 1..9879: note = derived and/or modified CDS sequence (opt4) from DENV-1__FJ850069__SS-prME
  source 1..9879: mol_type = other RNA
agcgtgaccatgctgctgatgctgatgcccaccgccctggccttccacctgaccaccagaggcggcgagccccacatgatcgtgggcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggtgaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcttcatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcatcagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcctggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccggctggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacaccgagggcgccctgtggtga

SEQ ID NO: 15924 - RNA, 9879 nt, synthetic construct
  misc_feature 1..9879: note = derived and/or modified CDS sequence (opt4) from DENV-1__FJ639680__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccacaaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15925 - RNA, 9879 nt, synthetic construct
  misc_feature 1..9879: note = derived and/or modified CDS sequence (opt4) from DENV-1__FJ639682__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaagaccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgctgagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatccccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15926 - RNA, 9879 nt, synthetic construct
  misc_feature 1..9879: note = derived and/or modified CDS sequence (opt4) from DENV-1__JQ287664__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcttcatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaaagtacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcatcagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcctggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccttcgactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacaccgagggcgccctgtggtga

SEQ ID NO: 15927 - RNA, 9879 nt, synthetic construct
  misc_feature 1..9879: note = derived and/or modified CDS sequence (opt4) from DENV-1__FJ639683__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcctggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15928 - RNA, 9879 nt, synthetic construct
  misc_feature 1..9879: note = derived and/or modified CDS sequence (opt4) from DENV-1__FJ639684__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgtgcccgagggcgccctgtggtga

SEQ ID NO: 15929 - RNA, 9879 nt, synthetic construct
  misc_feature 1..9879: note = derived and/or modified CDS sequence (opt4) from DENV-1__FJ639685__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcgtgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccatcctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15930 - RNA, 9879 nt, synthetic construct
  misc_feature 1..9879: note = derived and/or modified CDS sequence (opt4) from DENV-1__FJ639686__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcagatacgagggcaccgacgccccctgcaagatccccttcagcacccaggacgagagaggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggagaagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagatcaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15931 - RNA, 9879 nt, synthetic construct
  misc_feature 1..9879: note = derived and/or modified CDS sequence (opt4) from DENV-1__FJ639687__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgccgaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgaaggagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15932 - RNA, 9879 nt, synthetic construct
  misc_feature 1..9879: note = derived and/or modified CDS sequence (opt4) from DENV-1__FJ639688__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacgtgtgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaccagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatggccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatctaccaggtgagaagactgatcggcaacgagaactacctggactacatgaccagcatgaagagattcaagaacgagagcgaccccgagggcgccctgtggtga

SEQ ID NO: 15933 - RNA, 9879 nt, synthetic construct
  misc_feature 1..9879: note = derived and/or modified CDS sequence (opt4) from DENV-1__FJ639689__SS-prME
  source 1..9879: mol_type = other RNA
agcgtgaccatgctgctgatgctgatgcccaccgccctggccttccacctgaccatcagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggagaagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgaccgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatcctgaagctgctgaccgacttccagccccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcgtgatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagatcaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15934 - RNA, 9879 nt, synthetic construct
  misc_feature 1..9879: note = derived and/or modified CDS sequence (opt4) from DENV-1__FJ639690__SS-prME
  source 1..9879: mol_type = other RNA
agcgtgaccatgctgctgatgctgatgcccaccgccctggccttccacctgaccatcagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagatcggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggagaagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgaccgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatcctgaagctgctgaccgacttccagccccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagatcaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15935 - RNA, 9879 nt, synthetic construct
  misc_feature 1..9879: note = derived and/or modified CDS sequence (opt4) from DENV-1__FJ639691__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagaaccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacctggagggcgccctgtggtga

SEQ ID NO: 15936 - RNA, 9879 nt, synthetic construct
  misc_feature 1..9879: note = derived and/or modified CDS sequence (opt4) from DENV-1__FJ639692__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagagcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccctgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcaccgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15937 - RNA, 9879 nt, synthetic construct
  misc_feature 1..9879: note = derived and/or modified CDS sequence (opt4) from DENV-1__FJ639693__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgccgaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccgtgggcttccagaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccggccccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15938 - RNA, 9879 nt, synthetic construct
  misc_feature 1..9879: note = derived and/or modified CDS sequence (opt4) from DENV-1__FJ639694__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggagaagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagatcaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcaactggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15939 - RNA, 9879 nt, synthetic construct
  misc_feature 1..9879: note = derived and/or modified CDS sequence (opt4) from DENV-1__FJ639695__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaagccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggtgtggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15940 - RNA, 9879 nt, synthetic construct
  misc_feature 1..9879: note = derived and/or modified CDS sequence (opt4) from DENV-1__FJ639696__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacctggagggcgccctgtggtga

SEQ ID NO: 15941 - RNA, 9879 nt, synthetic construct
  misc_feature 1..9879: note = derived and/or modified CDS sequence (opt4) from DENV-1__HM181937__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatcgaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15942 - RNA, 9879 nt, synthetic construct
  misc_feature 1..9879: note = derived and/or modified CDS sequence (opt4) from DENV-1__HM181939__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccatcaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaacagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15943 - RNA, 9879 nt, synthetic construct
  misc_feature 1..9879: note = derived and/or modified CDS sequence (opt4) from DENV-1__HM181942__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaacagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15944 - RNA, 9879 nt, synthetic construct
  misc_feature 1..9879: note = derived and/or modified CDS sequence (opt4) from DENV-1__HM488255__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagagcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcagaggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15945 - RNA, 9879 nt, synthetic construct
  misc_feature 1..9879: note = derived and/or modified CDS sequence (opt4) from DENV-1__HM181944__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaacagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15946 - RNA, 9879 nt, synthetic construct
  misc_feature 1..9879: note = derived and/or modified CDS sequence (opt4) from DENV-1__HM181946__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcagatacgagggcaccgacgccccctgcaagatccccttcagcacccaggacgagagaggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggagaagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15947 - RNA, 9879 nt, synthetic construct
  misc_feature 1..9879: note = derived and/or modified CDS sequence (opt4) from DENV-1__HM181948__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15948 - RNA, 9879 nt, synthetic construct
  misc_feature 1..9879: note = derived and/or modified CDS sequence (opt4) from DENV-1__HM181949__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccggccacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcagaggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15949 - RNA, 9879 nt, synthetic construct
  misc_feature 1..9879: note = derived and/or modified CDS sequence (opt4) from DENV-1__HM181950__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcgccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacagcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15950 - RNA, 9879 nt, synthetic construct
  misc_feature 1..9879: note = derived and/or modified CDS sequence (opt4) from DENV-1__HM181952__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccaaggccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcgtgggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 15951 - RNA, 9879 nt, synthetic construct
  misc_feature 1..9879: note = derived and/or modified CDS sequence (opt4) from DENV-1__HM181953__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagctggagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15952 - RNA, 9879 nt, synthetic construct
  misc_feature 1..9879: note = derived and/or modified CDS sequence (opt4) from DENV-1__KF921933__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcaagtgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagactgggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacggcagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15953 - RNA, 9879 nt, synthetic construct
  misc_feature 1..9879: note = derived and/or modified CDS sequence (opt4) from DENV-1__HM181954__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggacccccggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcgccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15954 - RNA, 9879 nt, synthetic construct
  misc_feature 1..9879: note = derived and/or modified CDS sequence (opt4) from DENV-1__HM181955__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagagcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga
